US012415860B2

(12) United States Patent
Lin et al.

(10) Patent No.: US 12,415,860 B2
(45) Date of Patent: Sep. 16, 2025

(54) BINDING MOIETY FOR CONDITIONAL ACTIVATION OF IMMUNOGLOBULIN MOLECULES

(71) Applicant: Harpoon Therapeutics, Inc., South San Francisco, CA (US)

(72) Inventors: Shuoyen Jack Lin, San Bruno, CA (US); Richard J. Austin, San Francisco, CA (US); Bryan D. Lemon, Mountain View, CA (US); Kathryn Kwant, San Bruno, CA (US); Sony S. Rocha, San Francisco, CA (US); Holger Wesche, San Francisco, CA (US)

(73) Assignee: Harpoon Therapeutics, Inc., South San Francisco, CA (US)

( * ) Notice: Subject to any disclaimer, the term of this patent is extended or adjusted under 35 U.S.C. 154(b) by 163 days.

(21) Appl. No.: 17/055,096

(22) PCT Filed: May 14, 2019

(86) PCT No.: PCT/US2019/032307
§ 371 (c)(1),
(2) Date: Nov. 12, 2020

(87) PCT Pub. No.: WO2019/222283
PCT Pub. Date: Nov. 21, 2019

(65) Prior Publication Data
US 2021/0292421 A1 Sep. 23, 2021

Related U.S. Application Data

(60) Provisional application No. 62/756,453, filed on Nov. 6, 2018, provisional application No. 62/756,429, filed on Nov. 6, 2018, provisional application No. 62/671,344, filed on May 14, 2018, provisional application No. 62/671,349, filed on May 14, 2018.

(51) Int. Cl.

| | |
|---|---|
| *C07K 16/28* | (2006.01) |
| *C07K 16/00* | (2006.01) |
| *C07K 16/30* | (2006.01) |
| *A61K 39/00* | (2006.01) |

(52) U.S. Cl.
CPC ...... *C07K 16/2863* (2013.01); *C07K 16/2809* (2013.01); *C07K 16/2878* (2013.01); *C07K 16/3069* (2013.01); *A61K 2039/505* (2013.01); *C07K 2317/24* (2013.01); *C07K 2317/31* (2013.01); *C07K 2317/33* (2013.01); *C07K 2317/34* (2013.01); *C07K 2317/565* (2013.01); *C07K 2317/569* (2013.01); *C07K 2317/60* (2013.01); *C07K 2317/73* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 4,816,567 | A | 3/1989 | Cabilly et al. |
| 4,943,533 | A | 7/1990 | Mendelsohn et al. |
| 5,061,620 | A | 10/1991 | Tsukamoto et al. |
| 5,199,942 | A | 4/1993 | Gillis |
| 5,225,539 | A | 7/1993 | Winter |
| 5,350,674 | A | 9/1994 | Boenisch et al. |
| 5,399,346 | A | 3/1995 | Anderson et al. |
| 5,530,101 | A | 6/1996 | Queen et al. |
| 5,565,332 | A | 10/1996 | Hoogenboom et al. |
| 5,580,859 | A | 12/1996 | Felgner et al. |
| 5,585,089 | A | 12/1996 | Queen et al. |
| 5,585,362 | A | 12/1996 | Wilson et al. |
| 5,589,466 | A | 12/1996 | Felgner et al. |
| 5,759,808 | A | 6/1998 | Casterman et al. |
| 5,766,886 | A | 6/1998 | Studnicka et al. |
| 5,773,292 | A | 6/1998 | Bander |
| 5,800,988 | A | 9/1998 | Casterman et al. |
| 5,840,526 | A | 11/1998 | Casterman et al. |
| 5,844,093 | A | 12/1998 | Kettleborough et al. |
| 5,858,358 | A | 1/1999 | June et al. |
| 5,859,205 | A | 1/1999 | Adair et al. |
| 5,874,541 | A | 2/1999 | Casterman et al. |
| 5,883,223 | A | 3/1999 | Gray |

(Continued)

FOREIGN PATENT DOCUMENTS

| | | | |
|---|---|---|---|
| CA | 3040823 | A1 | 4/2018 |
| CN | 1563092 | A | 1/2005 |

(Continued)

OTHER PUBLICATIONS

Agata et al. Expression of the PD-1 antigen on the surface of stimulated mouse T and B lymphocytes. Int. Immunol 8:765-75 (1996).
Al-Lazikani et al. Standard conformations for the canonical structures of immunoglobulins. J. Mol Biology 273(4):927-948 (1997).
Almagro et al. Humanization of antibodies. Front Biosci 13:1619-1633 (2008).
Altschul et al. Basic local alignment search tool. J Mol Biol 215(3):403-410 (1990).
Altschul, et al. Gapped BLAST and PSI-BLAST: a new generation of protein database search programs. Nucleic Acids Res 25:3389-3402 (1977).

(Continued)

*Primary Examiner* — Agnieszka Boesen

(74) *Attorney, Agent, or Firm* — Benjamin D. Atkins; Andrew W. Custer

(57) ABSTRACT

Disclosed herein are binding moieties that comprise non-CDR loops for masking the binding of a binding molecule to its target and CDRs for binding bulk serum proteins. Conditionally active target binding proteins that contain the binding moieties are also provided. Pharmaceutical compositions comprising the binding proteins disclosed herein and methods of using such formulations are further provided.

20 Claims, 35 Drawing Sheets

Specification includes a Sequence Listing.

(56) References Cited

U.S. PATENT DOCUMENTS

| | | |
|---|---|---|
| 6,005,079 A | 12/1999 | Casterman et al. |
| 6,015,695 A | 1/2000 | Casterman et al. |
| 6,107,090 A | 8/2000 | Bander |
| 6,120,766 A | 9/2000 | Hale et al. |
| 6,136,311 A | 10/2000 | Bander |
| 6,326,193 B1 | 12/2001 | Liu et al. |
| 6,331,415 B1 | 12/2001 | Cabilly et al. |
| 6,352,694 B1 | 3/2002 | June et al. |
| 6,407,213 B1 | 6/2002 | Carter et al. |
| 6,534,055 B1 | 3/2003 | June et al. |
| 6,548,640 B1 | 4/2003 | Winter |
| 6,670,453 B2 | 12/2003 | Frenken et al. |
| 6,692,964 B1 | 2/2004 | June et al. |
| 6,759,518 B1 | 7/2004 | Kontermann et al. |
| 6,767,711 B2 | 7/2004 | Bander |
| 6,797,514 B2 | 9/2004 | Berenson et al. |
| 6,867,041 B2 | 3/2005 | Berenson et al. |
| 6,887,466 B2 | 5/2005 | June et al. |
| 6,905,680 B2 | 6/2005 | June et al. |
| 6,905,681 B1 | 6/2005 | June et al. |
| 6,905,874 B2 | 6/2005 | Berenson et al. |
| 7,060,808 B1 | 6/2006 | Goldstein et al. |
| 7,067,318 B2 | 6/2006 | June et al. |
| 7,144,575 B2 | 12/2006 | June et al. |
| 7,163,680 B2 | 1/2007 | Bander |
| 7,172,869 B2 | 2/2007 | June et al. |
| 7,175,843 B2 | 2/2007 | June et al. |
| 7,232,566 B2 | 6/2007 | June et al. |
| 7,247,301 B2 | 7/2007 | van de Winkel et al. |
| 7,262,276 B2 | 8/2007 | Huang et al. |
| 7,595,378 B2 | 9/2009 | van de Winkel et al. |
| 7,666,414 B2 | 2/2010 | Bander |
| 7,723,484 B2 | 5/2010 | Beidler et al. |
| 7,807,162 B2 | 10/2010 | Silence |
| 7,850,971 B2 | 12/2010 | Maddon et al. |
| 7,939,072 B2 | 5/2011 | Yarden et al. |
| 8,114,965 B2 | 2/2012 | Maddon et al. |
| 8,188,223 B2 | 5/2012 | Beirnaert et al. |
| 8,236,308 B2 | 8/2012 | Kischel et al. |
| 8,470,330 B2 | 6/2013 | Schuelke et al. |
| 8,623,356 B2 | 1/2014 | Christopherson et al. |
| 8,629,244 B2 | 1/2014 | Kolkman et al. |
| 8,703,135 B2 | 4/2014 | Beste et al. |
| 8,784,821 B1 | 7/2014 | Kufer et al. |
| 8,846,042 B2 | 9/2014 | Zhou |
| 8,907,071 B2 | 12/2014 | Sullivan et al. |
| 8,937,164 B2 | 1/2015 | Descamps et al. |
| 8,986,972 B2 | 3/2015 | Stull et al. |
| 9,089,615 B2 | 7/2015 | Stull et al. |
| 9,089,616 B2 | 7/2015 | Stull et al. |
| 9,089,617 B2 | 7/2015 | Stull et al. |
| 9,090,683 B2 | 7/2015 | Stull et al. |
| 9,107,961 B2 | 8/2015 | Stull et al. |
| 9,127,071 B2 | 9/2015 | Yoshida et al. |
| 9,133,271 B1 | 9/2015 | Stull et al. |
| 9,155,803 B1 | 10/2015 | Stull et al. |
| 9,169,316 B2 | 10/2015 | Baty et al. |
| 9,309,327 B2 | 4/2016 | Humphreys et al. |
| 9,327,022 B2 | 5/2016 | Zhang et al. |
| 9,334,318 B1 | 5/2016 | Stull et al. |
| 9,340,621 B2 | 5/2016 | Kufer et al. |
| 9,345,787 B2 | 5/2016 | Hemminki et al. |
| 9,352,051 B1 | 5/2016 | Stull et al. |
| 9,353,182 B2 | 5/2016 | Stull et al. |
| 9,358,304 B1 | 6/2016 | Stull et al. |
| 9,480,757 B2 | 11/2016 | Stull et al. |
| 9,481,724 B2 | 11/2016 | Ravetch et al. |
| 9,486,537 B2 | 11/2016 | Stull et al. |
| 9,708,412 B2 | 7/2017 | Baeuerle et al. |
| 9,764,042 B1 | 9/2017 | Stull et al. |
| 9,770,518 B1 | 9/2017 | Stull et al. |
| 9,775,916 B1 | 10/2017 | Stull et al. |
| 9,855,343 B2 | 1/2018 | Stull et al. |
| 9,861,708 B2 | 1/2018 | Stull et al. |
| 9,867,887 B1 | 1/2018 | Stull et al. |
| 9,878,053 B2 | 1/2018 | Stull et al. |
| 9,920,115 B2 | 3/2018 | Dubridge et al. |
| 9,931,420 B2 | 4/2018 | Stull et al. |
| 9,931,421 B2 | 4/2018 | Stull et al. |
| 9,937,268 B2 | 4/2018 | Stull et al. |
| 10,066,016 B2 | 9/2018 | Dubridge et al. |
| 10,100,106 B2 | 10/2018 | Dubridge et al. |
| 10,137,204 B2 | 11/2018 | Stull et al. |
| 10,428,120 B2 | 10/2019 | Kontermann et al. |
| 10,543,271 B2 | 1/2020 | Wesche et al. |
| 10,544,221 B2 | 1/2020 | Dubridge et al. |
| 10,730,954 B2 | 8/2020 | Wesche et al. |
| 10,815,311 B2 | 10/2020 | Wesche et al. |
| 10,844,134 B2 | 11/2020 | Baeuerle et al. |
| 10,849,973 B2 | 12/2020 | Dubridge et al. |
| 11,111,311 B2 | 9/2021 | Yoshida et al. |
| 11,180,563 B2 | 11/2021 | Wesche et al. |
| 11,400,157 B2 * | 8/2022 | Igawa ................ C07K 14/00 |
| 2004/0101519 A1 | 5/2004 | June et al. |
| 2005/0042664 A1 | 2/2005 | Wu et al. |
| 2005/0048617 A1 | 3/2005 | Wu et al. |
| 2005/0100543 A1 | 5/2005 | Hansen et al. |
| 2005/0175606 A1 | 8/2005 | Huang et al. |
| 2006/0034810 A1 | 2/2006 | Riley et al. |
| 2006/0046971 A1 | 3/2006 | Stuhler et al. |
| 2006/0121005 A1 | 6/2006 | Berenson et al. |
| 2006/0228364 A1 | 10/2006 | Dennis et al. |
| 2006/0252096 A1 | 11/2006 | Zha et al. |
| 2007/0014794 A1 | 1/2007 | Carter et al. |
| 2007/0178082 A1 | 8/2007 | Silence et al. |
| 2007/0269422 A1 | 11/2007 | Beirnaert et al. |
| 2008/0069772 A1 | 3/2008 | Stuhler et al. |
| 2008/0260757 A1 | 10/2008 | Holt et al. |
| 2009/0117108 A1 | 5/2009 | Wang et al. |
| 2009/0136485 A1 | 5/2009 | Chu et al. |
| 2009/0259026 A1 | 10/2009 | Tomlinson et al. |
| 2010/0122358 A1 | 5/2010 | Brueggemann et al. |
| 2010/0150918 A1 | 6/2010 | Kufer et al. |
| 2010/0166734 A1 | 7/2010 | Dolk |
| 2010/0189651 A1 | 7/2010 | Stagliano et al. |
| 2010/0189727 A1 | 7/2010 | Rodeck et al. |
| 2010/0266531 A1 | 10/2010 | Hsieh et al. |
| 2010/0291112 A1 | 11/2010 | Kellner et al. |
| 2010/0311119 A1 | 12/2010 | Hermans et al. |
| 2011/0129458 A1 | 6/2011 | Dolk et al. |
| 2011/0165621 A1 | 7/2011 | Dreier et al. |
| 2011/0262439 A1 | 10/2011 | Kufer et al. |
| 2011/0275787 A1 | 11/2011 | Kufer et al. |
| 2011/0313135 A1 | 12/2011 | Vanhove et al. |
| 2012/0039899 A1 | 2/2012 | Olsen et al. |
| 2012/0231024 A1 | 9/2012 | Elsaesser-Beile et al. |
| 2012/0328619 A1 | 12/2012 | Fey et al. |
| 2013/0017200 A1 | 1/2013 | Scheer et al. |
| 2013/0136744 A1 | 5/2013 | Bouche et al. |
| 2013/0266568 A1 | 10/2013 | Brinkmann et al. |
| 2013/0267686 A1 | 10/2013 | Brinkmann et al. |
| 2013/0273055 A1 | 10/2013 | Borges et al. |
| 2013/0315906 A1 | 11/2013 | Lowman et al. |
| 2013/0330335 A1 | 12/2013 | Bremel et al. |
| 2014/0004121 A1 | 1/2014 | Fanslow, III et al. |
| 2014/0023664 A1 | 1/2014 | Lowman et al. |
| 2014/0045195 A1 | 2/2014 | Daugherty et al. |
| 2014/0073767 A1 | 3/2014 | Lee et al. |
| 2014/0088295 A1 | 3/2014 | Smith et al. |
| 2014/0205601 A1 | 7/2014 | Beirnaert et al. |
| 2014/0242075 A1 | 8/2014 | Parren et al. |
| 2014/0302037 A1 | 10/2014 | Borges et al. |
| 2014/0308285 A1 | 10/2014 | Yan et al. |
| 2014/0322218 A1 | 10/2014 | Xiao et al. |
| 2015/0037334 A1 | 2/2015 | Kufer et al. |
| 2015/0056206 A1 | 2/2015 | Zhou |
| 2015/0064169 A1 * | 3/2015 | Wang ................ C07K 16/36 536/23.53 |
| 2015/0079088 A1 | 3/2015 | Lowman et al. |
| 2015/0079093 A1 | 3/2015 | Stuhler |
| 2015/0093336 A1 | 4/2015 | Van Ginderachter et al. |
| 2015/0174268 A1 | 6/2015 | Li et al. |
| 2015/0175697 A1 | 6/2015 | Bonvini et al. |
| 2015/0183875 A1 | 7/2015 | Cobbold et al. |

(56) References Cited

U.S. PATENT DOCUMENTS

| | | |
|---|---|---|
| 2015/0232557 A1 | 8/2015 | Tan et al. |
| 2015/0274836 A1 | 10/2015 | Ho et al. |
| 2015/0274844 A1 | 10/2015 | Blankenship et al. |
| 2015/0328332 A1 | 11/2015 | Stull et al. |
| 2016/0017058 A1 | 1/2016 | Kim et al. |
| 2016/0024174 A1 | 1/2016 | Odunsi et al. |
| 2016/0032011 A1 | 2/2016 | Zhang et al. |
| 2016/0032019 A1 | 2/2016 | Xiao et al. |
| 2016/0039942 A1 | 2/2016 | Cobbold et al. |
| 2016/0068605 A1 | 3/2016 | Nemeth et al. |
| 2016/0115241 A1 | 4/2016 | Yan et al. |
| 2016/0130331 A1 | 5/2016 | Stull et al. |
| 2016/0215063 A1 | 7/2016 | Bernett et al. |
| 2016/0251440 A1 | 9/2016 | Roobrouck et al. |
| 2016/0257721 A1 | 9/2016 | Lieber et al. |
| 2016/0319040 A1 | 11/2016 | Dreier et al. |
| 2016/0340444 A1 | 11/2016 | Baeuerle et al. |
| 2016/0355842 A1 | 12/2016 | Parks et al. |
| 2017/0029502 A1 | 2/2017 | Raum et al. |
| 2017/0037149 A1 | 2/2017 | Raum et al. |
| 2017/0152316 A1 | 6/2017 | Cobbold et al. |
| 2017/0204164 A1 | 7/2017 | Himmler et al. |
| 2017/0275373 A1 | 9/2017 | Kufer et al. |
| 2017/0298149 A1 | 10/2017 | Baeuerle et al. |
| 2017/0334979 A1 | 11/2017 | Dubridge et al. |
| 2017/0334997 A1 | 11/2017 | Dubridge et al. |
| 2017/0369563 A1 | 12/2017 | Dubridge et al. |
| 2018/0016323 A1 | 1/2018 | Brandenburg et al. |
| 2018/0134789 A1 | 5/2018 | Baeuerle et al. |
| 2018/0148508 A1 | 5/2018 | Wang et al. |
| 2018/0318417 A1 | 11/2018 | Schuetz et al. |
| 2018/0326060 A1 | 11/2018 | Wesche et al. |
| 2018/0346601 A1 | 12/2018 | Dettling et al. |
| 2019/0031749 A1 | 1/2019 | Dubridge et al. |
| 2019/0046656 A1 | 2/2019 | Stull et al. |
| 2019/0092862 A1 | 3/2019 | Cui et al. |
| 2019/0112381 A1 | 4/2019 | Wesche et al. |
| 2019/0135930 A1 | 5/2019 | Wesche et al. |
| 2019/0225702 A1 | 7/2019 | Baeuerle et al. |
| 2019/0247510 A1 | 8/2019 | Stull et al. |
| 2020/0115461 A1 | 4/2020 | Evnin et al. |
| 2020/0148771 A1 | 5/2020 | Paeuerle et al. |
| 2020/0231672 A1 | 7/2020 | Dubridge et al. |
| 2020/0270362 A1 | 8/2020 | Wesche et al. |
| 2020/0289646 A1 | 9/2020 | Wesche et al. |
| 2021/0047439 A1 | 2/2021 | Wesche et al. |
| 2021/0095047 A1 | 4/2021 | Baeuerle et al. |
| 2021/0100902 A1 | 4/2021 | Dubridge et al. |
| 2021/0171649 A1 | 6/2021 | Wesche et al. |
| 2021/0179735 A1 | 6/2021 | Baeuerle et al. |
| 2021/0269530 A1 | 9/2021 | Lin et al. |
| 2021/0284728 A1 | 9/2021 | Lin et al. |
| 2021/0355219 A1 | 11/2021 | Lin et al. |
| 2021/0380715 A1 | 12/2021 | Yoshida et al. |
| 2022/0017626 A1 | 1/2022 | Wesche et al. |
| 2022/0054544 A1 | 2/2022 | Lin et al. |
| 2022/0098311 A1 | 3/2022 | Wesche et al. |
| 2022/0112297 A1 | 4/2022 | Wesche et al. |
| 2022/0267462 A1 | 8/2022 | Wesche et al. |
| 2023/0257451 A1 | 8/2023 | Dubridge et al. |
| 2024/0084009 A1 | 3/2024 | Dubridge et al. |
| 2024/0084035 A1 | 3/2024 | Molloy et al. |
| 2024/0100157 A1 | 3/2024 | Wesche et al. |

FOREIGN PATENT DOCUMENTS

| | | |
|---|---|---|
| CN | 101557817 A | 10/2009 |
| CN | 101646689 A | 2/2010 |
| CN | 105968201 A | 9/2016 |
| CN | 105968204 A | 9/2016 |
| CN | 108137706 A | 6/2018 |
| CN | 109593786 A | 4/2019 |
| EP | 0239400 A2 | 9/1987 |
| EP | 0519596 A1 | 12/1992 |
| EP | 0592106 A1 | 4/1994 |
| EP | 1378520 A1 | 1/2004 |
| EP | 1736484 A1 | 12/2006 |
| EP | 2336179 A1 | 6/2011 |
| EP | 2817338 A2 | 12/2014 |
| EP | 3038659 A1 | 7/2016 |
| EP | 3093293 A1 | 11/2016 |
| EP | 3093294 A1 | 11/2016 |
| EP | 3095797 A1 | 11/2016 |
| EP | 3107576 A1 | 12/2016 |
| EP | 3261650 A1 | 1/2018 |
| EP | 3337517 A2 | 6/2018 |
| EP | 3458050 A1 | 3/2019 |
| EP | 3556400 A1 | 10/2019 |
| FR | 901228 A | 7/1945 |
| JP | 2005501517 A | 1/2005 |
| JP | 2016500655 A | 1/2016 |
| JP | 2019052750 A | 4/2019 |
| KR | 20180030477 A | 3/2018 |
| WO | WO-9109967 A1 | 7/1991 |
| WO | WO-9307105 A1 | 4/1993 |
| WO | WO-9404678 A1 | 3/1994 |
| WO | WO-9937681 A2 | 7/1999 |
| WO | WO-0043507 A1 | 7/2000 |
| WO | WO-0190190 A2 | 11/2001 |
| WO | WO-0196584 A2 | 12/2001 |
| WO | WO-02085945 A2 | 10/2002 |
| WO | WO-03025020 A1 | 3/2003 |
| WO | WO-03035694 A2 | 5/2003 |
| WO | WO-03064606 A2 | 8/2003 |
| WO | WO-2004003019 A2 | 1/2004 |
| WO | WO-2004041867 A2 | 5/2004 |
| WO | WO-2004042404 A1 | 5/2004 |
| WO | WO-2004049794 A2 | 6/2004 |
| WO | WO-2005040220 A1 | 5/2005 |
| WO | WO-2006020258 A2 | 2/2006 |
| WO | WO-2006122786 A2 | 11/2006 |
| WO | WO-2006122787 A1 | 11/2006 |
| WO | WO-2007024715 A2 | 3/2007 |
| WO | WO-2007042261 A2 | 4/2007 |
| WO | WO-2007062466 A1 | 6/2007 |
| WO | WO-2007115230 A2 | 10/2007 |
| WO | WO-2008028977 A2 | 3/2008 |
| WO | WO-2009025846 A2 | 2/2009 |
| WO | WO-2009030285 A1 | 3/2009 |
| WO | WO-2009035577 A1 | 3/2009 |
| WO | WO-2009147248 A2 | 12/2009 |
| WO | WO-2010003118 A1 | 1/2010 |
| WO | WO-2010037836 A2 | 4/2010 |
| WO | WO-2010037837 A2 | 4/2010 |
| WO | 2010081173 A2 | 7/2010 |
| WO | WO-2011039368 A2 | 4/2011 |
| WO | WO-2011051327 A2 | 5/2011 |
| WO | WO-2011079283 A1 | 6/2011 |
| WO | WO-2011117423 A1 | 9/2011 |
| WO | WO-2011161260 A1 | 12/2011 |
| WO | WO-2012131053 A1 | 10/2012 |
| WO | WO-2012138475 A1 | 10/2012 |
| WO | WO-2012158818 A2 | 11/2012 |
| WO | WO-2012175400 A1 | 12/2012 |
| WO | WO-2013036130 A1 | 3/2013 |
| WO | WO-2013045707 A2 | 4/2013 |
| WO | WO-2013053725 A1 | 4/2013 |
| WO | WO-2013104804 A2 | 7/2013 |
| WO | WO-2013110531 A1 | 8/2013 |
| WO | WO-2013126712 A1 | 8/2013 |
| WO | WO-2013128027 A1 | 9/2013 |
| WO | WO-2013128194 A1 | 9/2013 |
| WO | WO-2014012085 A2 | 1/2014 |
| WO | WO-2014033304 A2 | 3/2014 |
| WO | WO-2014052064 A1 | 4/2014 |
| WO | WO-2014138306 A1 | 9/2014 |
| WO | WO-2014140358 A1 | 9/2014 |
| WO | WO-2014144689 A1 | 9/2014 |
| WO | WO-2014151910 A1 | 9/2014 |
| WO | WO-2015031693 A1 | 3/2015 |
| WO | WO-2015103072 A1 | 7/2015 |
| WO | WO-2015127407 A1 | 8/2015 |
| WO | WO-2015146437 A1 | 10/2015 |
| WO | WO-2015150447 A1 | 10/2015 |

(56) References Cited

FOREIGN PATENT DOCUMENTS

| WO | WO-2015184207 A1 | 12/2015 | | |
|---|---|---|---|---|
| WO | WO-2016009029 A1 | 1/2016 | | |
| WO | WO-2016046778 A2 | 3/2016 | | |
| WO | WO-2016055551 A1 | 4/2016 | | |
| WO | WO-2016105450 A2 | 6/2016 | | |
| WO | WO-2016130819 A2 | 8/2016 | | |
| WO | WO-2016138038 A1 | 9/2016 | | |
| WO | WO-2016171999 A2 | 10/2016 | | |
| WO | 2016187594 A1 | 11/2016 | | |
| WO | WO-2016179003 A1 | 11/2016 | | |
| WO | WO-2016182064 A1 | 11/2016 | | |
| WO | WO-2016187101 A2 | 11/2016 | | |
| WO | WO-2016210447 A1 | 12/2016 | | |
| WO | WO-2017021356 A1 | 2/2017 | | |
| WO | WO-2017025038 A1 | 2/2017 | | |
| WO | WO-2017025698 A1 | 2/2017 | | |
| WO | WO-2017027392 A1 | 2/2017 | | |
| WO | WO-2017031104 A1 | 2/2017 | | |
| WO | WO-2017041749 A1 | 3/2017 | | |
| WO | WO-2017079528 A1 | 5/2017 | | |
| WO | WO-2017136549 A1 | 8/2017 | | |
| WO | 2017162587 A1 | 9/2017 | | |
| WO | WO 2017/156178 A | * | 9/2017 | ............ C07K 16/28 |
| WO | WO-2017156178 A1 | 9/2017 | | |
| WO | WO-2017157305 A1 | 9/2017 | | |
| WO | WO-2017161206 A1 | 9/2017 | | |
| WO | WO-2017201442 A1 | 11/2017 | | |
| WO | WO-2017201488 A1 | 11/2017 | | |
| WO | WO-2017201493 A1 | 11/2017 | | |
| WO | WO-2018017863 A1 | 1/2018 | | |
| WO | WO-2018026953 A1 | 2/2018 | | |
| WO | WO-2018067993 A1 | 4/2018 | | |
| WO | WO-2018071777 A1 | 4/2018 | | |
| WO | WO-2018098354 A1 | 5/2018 | | |
| WO | WO-2018098356 A1 | 5/2018 | | |
| WO | WO-2018119183 A2 | 6/2018 | | |
| WO | WO-2018136725 A1 | 7/2018 | | |
| WO | WO-2018160671 A1 | 9/2018 | | |
| WO | WO-2018160754 A2 | 9/2018 | | |
| WO | WO-2018165619 A1 | 9/2018 | | |
| WO | WO-2018204717 A1 | 11/2018 | | |
| WO | WO-2018209298 A1 | 11/2018 | | |
| WO | WO-2018209304 A1 | 11/2018 | | |
| WO | WO-2018232020 A1 | 12/2018 | | |
| WO | WO-2019075359 A1 | 4/2019 | | |
| WO | WO-2019075378 A1 | 4/2019 | | |
| WO | WO-2019222278 A1 | 11/2019 | | |
| WO | WO-2019222282 A1 | 11/2019 | | |
| WO | WO-2019222283 A1 | 11/2019 | | |
| WO | WO-2020060593 A1 | 3/2020 | | |
| WO | WO-2020061482 A1 | 3/2020 | | |
| WO | WO-2020061526 A1 | 3/2020 | | |
| WO | WO-2020069028 A1 | 4/2020 | | |
| WO | WO-2020232303 A1 | 11/2020 | | |
| WO | WO-2021097060 A1 | 5/2021 | | |
| WO | WO-2021231434 A1 | 11/2021 | | |

OTHER PUBLICATIONS

Argani et al. Mesothelin is overexpressed in the vast majority of ductal adenocarcinomas of the pancreas: identification of a new pancreatic cancer marker by serial analysis of gene expression (SAGE). Clin Cancer Res 7(12):3862-3868 (2001).
Austin et al. Cancer Research (Jul. 2018) vol. 78, No. 13, Supp. Supplement 1. Abstract No. 1781. Meeting Info: 2018 Annual Meeting of the American Association for Cancer Research, AACR 2018. Chicago, IL, United States. Apr. 14-Apr. 18, 2018).
Baca et al. Antibody humanization using monovalent phage display. J Biol Chem 272(16):10678-10684 (1997).
Baeuerle et al. Bispecific T-cell engaging antibodies for cancer therapy. Cancer Res 69:4941-4944 (2009).
Barrett et al. Treatment of advanced leukemia in mice with mRNA engineered T cells. Hum Gene Ther 22:1575-1586 (2011).
Batzer et al. Enhanced evolutionary PCR using oligonucleotides with inosine at the 3'- terminus. Nucleic Acids Res. 19(18):5081 (1991).
Baum et al. Antitumor activities of PSMAxCD3 diabodies by redirected T-cell lysis of prostate cancer cells. Immunotherapy 5(1):27-38 (2013).
Bedouelle et al. Diversity and junction residues as hotspots of binding energy in an antibody neutralizing the dengue virus. Febs J 273(1):34-46 (2006).
Bendell et al. Abstract 5552: First-in-human phase I study of HPN424, a tri-specific half-life extended PSMA-targeting T-cell engager in patients with metastatic castration-resistant prostate cancer (mCRPC). J Clin Oncol 38(15):5552 (May 2020).
Bird et al. Single-chain antigen-binding proteins. Science 242(4877):423-426 (1988).
Blank et al. Interaction of PD-L1 on tumor cells with PD-1 on tumor-specific T cells as a mechanism of immune evasion: implications for tumor immunotherapy. Cancer Immunol Immunother 54:307-314 (2005).
Bortoletto et al. Optimizing anti-CD3 affinity for effective T cell targeting against tumor cells. Eur J Immunol 32:3102-3107 (2002).
Bracci et al. Cyclophosphamide enhances the antitumor efficacy of adoptively transferred immune cells through the induction of cytokine expression, B-cell and T-cell homeostatic proliferation, and specific tumor infiltration. Clin Cancer Res 13(2 Pt 1):644-653 (2007).
Brown et al. Tolerance of single, but not multiple, amino acid replacements in antibody VH CDR 2: a means of minimizing B cell wastage from somatic hypermutation? J Immunol 156(9):3285-3291 (1996).
Caldas et al. Design and synthesis of germline-based hemi-humanized single-chain Fv against the CD18 surface antigen. Protein Eng 13(5):353-360 (2000).
Caldas et al. Humanization of the anti-CD18 antibody 6.7: an unexpected effect of a framework residue in binding to antigen. Mol Immunol. 39(15):941-952 (2003).
Carter et al. Humanization of an anti-p185HER2 antibody for human cancer therapy. PNAS USA 89(10):4285-4289 (1992).
Carter et al. PD-1: PD-L inhibitory pathway affects both CD4(+) and CD8(+) T cells and is overcome by IL-2. Eur J Immunol 32:634-643 (2002).
Casset et al. A peptide mimetic of an anti-CD4 monoclonal antibody by rational design. Biochemical and Biophysical Research Communication 307:198-205 (2003).
Chang et al. Loop-sequence features and stability determinants in antibody variable domains by high-throughput experiments. Structure 22(1):9-21 (2014).
Chang et al. Molecular cloning of mesothelin, a differentiation antigen present on mesothelium, mesotheliomas, and ovarian cancers. PNAS USA 93:136-140 (1996).
Chatalic et al. A Novel 111 In-labeled Anti-PSMA Nanobody for Targeted SPECT/CT Imaging of Prostate Cancer. J Nucl Med 56(7):1094-1099 and Supplemental Data (2015).
Chen et al. Fusion protein linkers: Property, design and functionality. Advanced Drug Delivery Reviews 65:1357-1369 (2013).
Chen et al. Selection and analysis of an optimized anti-VEGF antibody: Crystal structure of an affinity-matured Fab in complex with antigen. J Mol Bio 293:865-881 (1999).
Chien et al. Significant structural and functional change of an antigen-binding site by a distant amino acid substitution: proposal of a structural mechanism. PNAS USA 86(14):5532-5536 (1989).
Cho et al. Targeting B Cell Maturation Antigen (BCMA) in Multiple Myeloma: Potential Uses of BCMA-Based Immunotherapy. Front Immunol 9:1821 (2018).
Choi et al. Engineering of Immunoglobulin Fc heterodimers using yeast surface-displayed combinatorial Fc library screening. PLOS One 10(12):e0145349 (2015).
Chothia et al. Canonical structures for the hypervariable regions of immunoglobulins. J Mol Biol 196(4):901-917 (1987).
Chothia, et al. Conformations of immunoglobulin hypervariable regions. Nature 342(6252):877-83 (1989).
Corso et al. Real-time detection of mesothelin in pancreatic cancer cell line supernatant using an acoustic wave immunosensor. Cancer Detect Prev 30:180-187 (2006).

(56) References Cited

OTHER PUBLICATIONS

Cougot et al. 'Cap-tabolism'. Trends in Biochem Sci 29:436-444 (2001).
Couto et al. Anti-BA46 monoclonal antibody Mc3: humanization using a novel positional consensus and in vivo and in vitro characterization. Cancer Res 55(8):1717-1722 (1995).
Couto et al. Designing human consensus antibodies with minimal positional templates. Cancer Res 55(23 Supp):5973s-5977s (1995).
Creaney et al. Detection of malignant mesothelioma in asbestos-exposed individuals: the potential role of soluble mesothelin-related protein. Hematol. Oncol. Clin. North Am. 19:1025-1040 (2005).
Cristaudo et al. Clinical significance of serum mesothelin in patients with mesothelioma and lung cancer. Clin. Cancer Res. 13:5076-5081 (2007).
Dao et al. Targeting the intracellular WT1 oncogene product with a therapeutic human antibody. Sci Transl Med 5(176):176ra33 (2013).
De Genst et al. Antibody repertoire development in camelids. Dev Comp Immunol 30(1-2):187-198 (2006).
De Pascalis et al. Grafting of "abbreviated" complementarity-determining regions containing specificity-determining residues essential for ligand contact to engineer a less immunogenic humanized monoclonal antibody. J Immunol. 169(6):3076-3084 (2002).
Dennis et al. Imaging Tumors with an Albumin-Binding Fab, a Novel Tumor-Targeting Agent. Cancer Res 67(1):254-61 (2007).
Document D28—Investigation of human CD38 variants binding to monoclonal antibodies. Submitted by Pfizer to the European Patent Register on Apr. 30, 2014 in connection with their opposition to the EP2155783 patent. (3 pages) (2014).
Document D78—CD3ε N-terminal peptide bound to the CDRs of SP24. Submitted by Janssen Biotech to the European Patent Register on Mar. 18, 2016 in connection with their opposition to the EP2155783 patent (1 page) (2016).
Document D79—Interactions between CD3εand SP34 CDR residues. CD3ε residues are in ellipses, SP34 CDR residues are in boxes. Submitted by Janssen Biotech to the European Patent Register on Mar. 18, 2016 in connection with their opposition to the EP2155783 patent (1 page) (2016).
Document D83—Alignment of variable domains from the prior art and the patent. Submitted by Janssen Biotech to the European Patent Register on Mar. 18, 2016 in connection with their opposition to the EP2155783 patent (1 page) (2016).
Dong et al. B7-H1 pathway and its role in the evasion of tumor immunity. J Mol Med 81:281-287 (2003).
Elango et al. Optimized transfection of mRNA transcribed from a d(A/T)100 tail-containing vector. Biochim Biophys Res Commun 330:958-966 (2005).
Foote et al. Antibody Framework Residues Affecting the Conformation of the Hypervariable Loops. J. Mol. Biol. 224(2):487-99 (1992).
Frankel et al. Targeting T cells to tumor cells using bispecific antibodies. Curr Opin Chem Biol 17(3):385-392 (2013).
Freeman et al. Engagement of the PD-1 immunoinhibitory receptor by a novel B7 family member leads to negative regulation of lymphocyte activation. J Exp Med 192:1027-1034 (2000).
Garland et al. The use of Teflon cell culture bags to expand functionally active CD8+ cytotoxic T lymphocytes. J Immunol Meth 227(1-2):53-63 (1999).
Giusti et al. Somatic diversification of S107 from an antiphosphocholine to an anti-DNA autoantibody is due to a single base change in its heavy chain variable region. PNAS USA 84(9):2926-30 (1987).
Glaser et al. Novel antibody hinge regions for efficient production of CH2 domain-deleted antibodies. J. Biol. Chem. 280:41494-503 (2005).
Goldman et al. Enhancing Stability of Camelid and Shark Single Domain Antibodies: An Overview. Front. Immunol. 8:865 (2017).
Goodman et al. The Pharmaceutical Basis of Therapeutics. 6th ed. pp. 21-25 (1980).
Goswami et al. Developments and Challenges for mAb-Based Therapeutics. Antibodies 2:452-500 (2013).
Gross et al. Endowing T cells with antibody specificity using chimeric T cell receptors. Faseb J. 6(15):3370-3378 (1992).
Grupp et al. Chimeric antigen receptor-modified T cells for acute lymphoid leukemia. NEJM 368:1509-1518 (2013).
Gubbels et al. Mesothelin-MUC16 binding is a high affinity, N-glycan dependent interaction that facilitates peritoneal metastasis of ovarian tumors. Mol Cancer 5:50 (2006).
Gussow et al. Chapter 5: Humanization of Monoclonal Antibodies. Methods in Enzymology 203:99-121 (1991).
Haanen et al. Selective expansion of cross-reactive CD8(+) memory T cells by viral variants. J Exp Med 190(9):1319-1328 (1999).
Halaby et al. The immunoglobulin fold family: sequence analysis and 3D structure comparisons. Prot Eng 12(7):563-571 (1999).
Han et al. Masked Chimeric Antigen Receptor for Tumor-Specific Activation. Molecular Therapy 25(1):274-284 (2017).
Harding et al. The immunogenicity of humanized and fully human antibodies: residual immunogenicity resides in the CDR regions. MAbs 2(3):256-265 (2010).
Harmsen et al. Properties, production, and applications of camelid single-domain antibody fragments. Appl. Microbiol. Biotechnol. 77:13-22 (2007).
Hassan et al. Detection and quantitation of serum mesothelin, a tumor marker for patients with mesothelioma and ovarian cancer. Clin Cancer Res 12:447-453 (2006).
Hassan et al. Mesothelin: a new target for immunotherapy. Clin Cancer Res 10:3937-3942 (2004).
Hassan et al. Mesothelin targeted cancer immunotherapy. Eur J Cancer 44:46-53 (2008).
Hassan et al. Phase I study of SS1P, a recombinant anti-mesothelin immunotoxin given as a bolus I.V. infusion to patients with mesothelin-expressing mesothelioma, ovarian, and pancreatic cancers. Clin Cancer Res 13(17):5144-5149 (2007).
Hassan et al. Preclinical evaluation of MORAb-009, a chimeric antibody targeting tumor-associated mesothelin. Cancer Immun. 7:20 (2007).
Hellstrom et al. Mesothelin variant 1 is released from tumor cells as a diagnostic marker. Cancer Epidemiol Biomarkers Prev 15:1014-1020 (2006).
Hipp et al. A novel BCMA/CD3 bispecific T-cell engager for the treatment of multiple myeloma induces selective lysis in vitro and in vivo. Leukemia 31(8):1743-1751 (2017).
Ho et al. A novel high-affinity human monoclonal antibody to mesothelin. Int J Cancer 128:2020-2030 (2011).
Ho et al. Mesothelin expression in human lung cancer. Clin Cancer Res 13:1571-1575 (2007).
Ho et al. Mesothelin is shed from tumor cells. Cancer Epidemiol Biomarkers Prev 15:1751 (2006).
Holliger, et al. "Diabodies": small bivalent and bispecific antibody fragments. Proc Natl Acad Sci USA. Jul. 15, 1993; 90(14): 6444-6448. doi: 10.1073/pnas.90.14.6444.
Holm et al. Functional mapping and single chain construction of the anti-cytokeratin 8 monoclonal antibody TS1. Mol Immunol 44(6):1075-1084 (2007).
Holt et al. Anti-serum albumin domain antibodies for extending the half-lives of short-lived drugs. Protein Eng Des Sel 21(5):283-288 (2008).
Hopp et al. The effects of affinity and valency of an albumin-binding domain (ABD) on the half-life of a single-chain diabody-ABD fusion protein. Protein Eng. Des. Sel. 23(11):827-34 (2010).
Huck et al. Sequence of a human immunoglobulin gamma 3 heavy chain constant region gene: comparison with the other human C gamma genes. Nucl. Acids Res. 14:1779-89 (1986).
Huston et al. Protein engineering of antibody binding sites: recovery of specific activity in an anti-digoxin single-chain Fv analogue produced in *Escherichia coli*. PNAS USA 85(16):5879-5883 (1988).
Hutchinson et al. Mutagenesis at a specific position in a DNA sequence. J Biol Chem 253:6551-6560 (1978).
Izumoto et al. Phase II clinical trial of Wilms tumor 1 peptide vaccination for patients with recurrent glioblastoma multiforme. J Neurosurg 108:963-971 (2008).

(56) References Cited

OTHER PUBLICATIONS

Janssen letter—Submission under Rule 116 EPC. Submitted by Janssen Biotech to the European Patent Register on Mar. 18, 2016 in connection with their opposition to the EP2155783 patent (6 pages) (2016).
Jones et al. Replacing the complementarity-determining regions in a human antibody with those from a mouse. Nature 321:522-525 (1986).
Kabat et al. Identical V region amino acid sequences and segments of sequences in antibodies of different specificities. Relative contributions of VH and VL genes, minigenes, and complementarity-determining regions to binding of antibody-combining sites. J Immunol 147:1709-1719 (1991).
Kabat et al. Sequences of proteins of immunological interest. NIH Publ. No. 91-3242 1:647-669 (1991).
Kalos et al. T cells with chimeric antigen receptors have potent antitumor effects and can establish memory in patients with advanced leukemia. Sci Transl Med 3(95):95ra73 (2011).
Kojima et al. Molecular cloning and expression of megakaryocyte potentiating factor cDNA. J Biol Chem 270:21984-21990 (1995).
Konishi et al. B7-H1 expression on non-small cell lung cancer cells and its relationship with tumor-infiltrating lymphocytes and their PD-1 expression. Clin Cancer Res 10:5094-5100 (2004).
Škrlec et al. Non-immunoglobulin scaffolds: a focus on their targets. Trends in Biotechnol 33:408-418 (2015).
Laabi et al. The BCMA gene, preferentially expressed during B lymphoid maturation, is bidirectionally transcribed. Nucleic Acids Res 22(7):1147-1154 (1994).
Latchman et al. PD-L2 is a second ligand for PD-1 and inhibits T cell activation. Nat Immunol 2:261-268 (2001).
Le Gall et al. Immunosuppressive properties of anti-CD3 single-chain Fv and diabody. J Immunol Methods 285(1):111-127 (2004).
Li et al. Development of novel tetravalent anti-CD20 antibodies with potent antitumor activity. Cancer Res 68:2400-2408 (2008).
Liu et al. A New Format of Single Chain Tri-specific Antibody with Diminished Molecular Size Efficiently Induces Ovarian Tumor Cell Killing. Biotechnology Letters 27(22):1821-1827 (2005).
Liu et al. MGD011, a CD19 x CD3 Dual Affinity Re-Targeting Bi-specific Molecule Incorporating Extended Circulating Half-life for the Treatment of B-cell Malignancies. Clin Cancer Res 23(6):1506-1518 (epub 2016) (2017).
Lowman et al. Monovalent phage display: A method for selecting variant proteins from random libraries. Methods 3:205-216 (1991).
Lu et al. In vitro and in vivo antitumor effect of a trivalent bispecific antibody targeting ErbB2 and CD16. Cancer Biol Ther. 7(11):1744-1750 (2008). .
Lutterbuese et al. T cell-engaging BiTE antibodies specific for EGFR potently eliminate KRAS- and BRAF-mutated colorectal cancer cells. PNAS 107:12605-12610 (2007).
Maccallum et al. Antibody-antigen interactions: contact analysis and binding site topography. J Mol Biol. 262(5):732-745 (1996).
Mariuzza et al. The structural basis of antigen-antibody recognition. Annu Rev Biophys Biophys Chem 16:139-159 (1987).
Milone et al. Chimeric receptors containing CD137 signal transduction domains mediate enhanced survival of T cells and increased antileukemic efficacy in vivo. Mol Ther 17(8):1453-1464 (2009).
Mirsky et al. Antibody-Specific Model of Amino Acid Substitution for Immunological Inferences from Alignments of Antibody Sequences. Mol. Biol. Evol. 32(3):806-819 (2014).
Müller et al. Improved Pharmacokinetics of Recombinant Bispecific Antibody Molecules by Fusion to Human Serum Albumin. J. Biol. Chem. 282(17):12650-60 (2007).
Morea et al. Antibody modeling: implications for engineering and design. Methods 20(3):267-279 (2000).
Moschella et al. Unraveling cancer chemoimmunotherapy mechanisms by gene and protein expression profiling of responses to cyclophosphamide. Cancer Res 71(10):3528-3539 (2011).
Muller et al. Improving the pharmacokinetic properties of biologics by fusion to an anti-HSA shark VNAR domain. MAbs 4(6):673-685 (2012).
Mumtaz et al. Design of liposomes for circumventing the reticuloendothelial cells. Glycobiology 5:505-10 (1991).
Muul et al. Persistence and expression of the adenosine deaminase gene for 12 years and immune reaction to gene transfer components: long-term results of the first clinical gene therapy trial. Blood 101(7):2563-2569 (2003).
Muyldermans. Nanobodies: natural single-domain antibodies. Annu Rev Biochem 82:775-797 (2013).
Nacheva et al. Preventing nondesired RNA-primed RNA extension catalyzed by T7 RNA polymerase. Eur J Biochem 270:1458-1465 (2003).
Nazarian et al. Characterization of bispecific T-cell Engager (BiTE) antibodies with a high-capacity T-cell dependent cellular cytotoxicity (TDCC) assay. J Biomol Screen 20:519-527 (2015).
Needleman et al. A general method applicable to the search for similarities in the amino acid sequence of two proteins. J. Mol. Biol. 48:443-453 (1970).
Nelson et al. Antibody fragments Hope and Hype. mAbs 2(1):77-83 (2010).
Nicholson et al. Construction and characterisation of a functional CD19 specific single chain Fv fragment for immunotherapy of B lineage leukaemia and lymphoma. Mol Immun 34(16-17):1157-1165 (1997).
Nishikawa et al. Nonviral vectors in the new millennium: delivery barriers in gene transfer. Human Gene Therapy. 12:861-870 (2001).
Nunez-Prado et al. The coming of age of engineered multivalent antibodies. Drug Discovery Today 20(5):588-594 (2015).
Ohiro et al. A homogeneous and noncompetitive immunoassay based on the enhanced fluorescence resonance energy transfer by leucine zipper interaction. Anal Chem 74(22):5786-5792 (2002).
Ohtsuka et al. An alternative approach to deoxyoligonucleotides as hybridization probes by insertion of Deoxyinosine at Ambiguous Codon Positions. J Biol Chem 260(5):2605-2608 (Mar. 10, 1985).
O'Keefe et al. Chapter 18: Prostate specific membrane antigen. In: Chung L.W.K., Isaacs W.B., Simons J.W. (eds) Prostate Cancer. Contemporary Cancer Research. Humana Press, Totowa, NJ (pp. 307-326) (2001).
Ordonez. Application of mesothelin immunostaining in tumor diagnosis. Am J Surg Pathol 27:1418-1428 (2003).
Padlan. Anatomy of the Antibody Molecule. Mol Immunol 31(3):169-217 (1994).
Padlan, et al., A possible procedure for reducing the immunogenicity of antibody variable domains while preserving their ligand-binding properties. Mol Immunol 28(4-5):489-498 (1991).
Padlan et al. Structure of an antibody-antigen complex: Crystal structure of the HyHEL-10 Fab-lysozyme complex. PNAS USA 86:5938-5942 (1989).
Pawluczkowycz et al. Binding of submaximal C1q promotes complement-dependent cytotoxicity (CDC) of B cells opsonized with anti-CD20 mAbs ofatumumab (OFA) or rituximab (RTX): considerably higher levels of CDC are induced by OFA than by RTX. J Immunol 183:749-758 (2009).
PCT/US2016/033644 International Search Report and Written Opinion dated Sep. 6, 2016.
PCT/US2017/033665 International Search Report and Written Opinion dated Oct. 18, 2017.
PCT/US2017/033673 International Search Report and Written Opinion dated Oct. 18, 2017.
PCT/US2017/056530 International Search Report and Written Opinion dated Jan. 23, 2018.
PCT/US2017/063121 International Search Report and Written Opinion dated Mar. 26, 2018.
PCT/US2017/063126 International Search Report and Written Opinion dated Apr. 5, 2018.
PCT/US2018/014396 International Search Report and Written Opinion dated Jun. 14, 2018.
PCT/US2018/020185 International Search Report and Written Opinion dated Jun. 15, 2018.
PCT/US2018/020307 International Search Report and Written Opinion dated Aug. 24, 2018.
PCT/US2018/030983 International Search Report and Written Opinion dated Sep. 25, 2018.

(56) References Cited

OTHER PUBLICATIONS

PCT/US2018/032418 International Search Report and Written Opinion dated Sep. 24, 2018.
PCT/US2018/032427 International Search Report and Written Opinion dated Sep. 13, 2018.
PCT/US2018/055659 International Search Report and Written Opinion dated Feb. 21, 2019.
PCT/US2018/055682 International Search Report and Written Opinion dated Mar. 1, 2019.
PCT/US2019/032224 International Search Report and Written Opinion dated Aug. 28, 2019.
PCT/US2019/032302 International Search Report and Written Opinion dated Aug. 22, 2019.
PCT/US2019/032306 International Search Report and Written Opinion dated Aug. 22, 2019.
PCT/US2019/032307 International Search Report and Written Opinion dated Aug. 22, 2019.
PCT/US2019/052206 International Search Report and Written Opinion dated Feb. 14, 2020.
PCT/US2019/052270 International Search Report and Written Opinion dated Mar. 5, 2020.
PCT/US2019/053017 International Search Report and Written Opinion dated Jan. 31, 2020.
PCT/US/2020/032985 International Search Report and Written Opinion dated Oct. 15, 2020.
Pearson et al. Improved Tools for Biological Sequence Comparison. PNAS USA 85:2444-48 (1988).
Pedersen et al. Comparison of surface accessible residues in human and murine immunoglobulin Fv domains. Implication for humanization of murine antibodies. J Mol Biol 235(3):959-973 (1994).
Pfizer letter—Opposition to European Patent EP2155783 (Application 08735001.3). Submitted by Pfizer to the European Patent Register on Apr. 30, 2014 in connection with their opposition to the EP2155783 patent. (pp. 1-23 and Appendix 1 on pp. 24-26) (2014).
Porter et al. Chimeric antigen receptor T cells persist and induce sustained remissions in relapsed refractory chronic lymphocytic leukemia. Sci Trans Med 7(303):303ra319 (2015).
Porter et al. Chimeric antigen receptor-modified T cells in chronic lymphoid leukemia. NEJM 365:725-733 (2011).
Presta. Antibody Engineering. Curr Op Struct Biol 2:593-596 (1992).
Presta et al. Humanization of an antibody directed against IgE. J Immunol 151:2623-2632 (1993).
Ramadoss et al. An Anti-B Cell Maturation Antigen Bispecific Antibody for Multiple Myeloma. J. Ann. Chem. Soc. 137(16):5288-91 (2015).
Riechmann et al. Reshaping human antibodies for therapy. Nature, 332.6162:323-7 (1988).
Riechmann et al. Single domain antibodies: comparison of camel VH and camelised human VH domains. J Immunol Methods 231(1-2):25-38 (1999).
Roguska et al. A comparison of two murine monoclonal antibodies humanized by CDR-grafting and variable domain resurfacing. Protein Eng 9(10):895-904 (1996).
Roguska et al. Humanization of murine monoclonal antibodies through variable domain resurfacing. PNAS 91:969-973 (1994).
Rosenberg et al. Use of tumor-infiltrating lymphocytes and interleukin-2 in the immunotherapy of patients with metastatic melanoma. A preliminary report. NEJM 319:1676 (1988).
Rosok et al. A Combinatorial Library Strategy for the Rapid Humanization of Anticarcinoma BR96 Fab. J Biol Chem 271:22611-22618 (1996).
Rossolini et al. Use of deoxyinosine-containing primers vs degenerate primers for polymerase chain reaction based on ambiguous sequence information. Mol Cell Probes 8(2):91-98 (1994).
Rozan et al. Single-domain antibody-based and linker-free bispecific antibodies targeting FcγRIII induce potent antitumor activity without recruiting regulatory T cells. Mol Cancer Ther 12(8):1481-1491 (2013).
Rudikoff et al. Single amino acid substitution altering antigen-binding Specificity. PNAS USA 79:1979-1983 (1982).
Rump et al. Binding of ovarian cancer antigen CA125/MUC16 to mesothelin mediates cell adhesion. J Biol Chem 279:9190-9198 (2004).
Running Deer et al. High-level expression of proteins in mammalian cells using transcription regulatory sequences from the Chinese hamster EF-1alpha gene. Biotechnol Prog. 20:880-889 (2004).
Sadelain et al. Targeting tumours with genetically enhanced T lymphocytes. Nat Rev Cancer 3(1):35-45 (2003).
Sadelain et al. The basic principles of chimeric antigen receptor design. Cancer Discov. 3(4):388-98 (2013).
Saerens et al. Identification of a universal VHH framework to graft non-canonical antigen-binding loops of camel single-domain antibodies. J. Mol. Biol. 352(3):597-607 (2005).
Sandhu. A rapid procedure for the humanization of monoclonal antibodies. Gene 150(2):409-410 (1994).
Sastry et al. Targeting hepatitis B virus-infected cells with a T-cell receptor-like antibody. J Virol 85(5):1935-1942 (2011).
Schenborn et al. A novel transcription property of SP6 and T7 RNA polymerases: dependence on template structure. Nuc Acids Res 13:6223-6236 (1985).
Scheraga. Predicting three-dimensional structures of oligopeptides. Rev Computational Chem 3:73-142 (1992).
Schmidt et al. Cloning and Characterization of Canine Prostate-Specific Membrane Antigen. The Prostate 73:642-650 (2013).
Schmittgen et al. Expression of prostate specific membrane antigen and three alternatively spliced variants of PSMA in prostate cancer patients. Int J Cancer 107:323-329 (2003).
Sergeeva et al. An anti-PR1/HLA-A2 T-cell receptor-like antibody mediates complement-dependent cytotoxicity against acute myeloid leukemia progenitor cells. Blood 117(16):4262-4272 (2011).
Sims et al. A humanized CD18 antibody can block function without cell destruction. J Immunol. 151:2296-2308 (1993).
Smirnova et al. Identification of new splice variants of the genes BAFF and BCMA. Mol. Immunol. 45 (4):1179-83 (2008).
Smith et al. Comparison of Biosequences. Advances in Applied Mathematics. 2:482-489 (1981).
Song et al. CD27 costimulation augments the survival and antitumor activity of redirected human T cells in vivo. Blood 119(3):696-706 (2012).
Spiess et al. Alternative molecular formats and therapeutic applications for bispecific antibodies. Mol. Immunol. 67(2 Pt A):95-106 (2015).
Stepinski et al. Synthesis and properties of mRNAs containing the novel 'anti-reverse' cap analogs 7-methyl(3'0-methyl)GpppG and 7-methyl(e'-deoxy)GpppG. RNA 7:1486-1495 (2001).
Sternjak et al. Cancer Research, (Jul. 2017) vol. 77, No. 13, Supp. Supplement 1. Abstract No. 3630. Meeting Info: American Association for Cancer Research Annual Meeting 2017. Washington, DC, United States. Apr. 1, 2017-Apr. 5, 2017.
Stork et al. A novel tri-functional antibody fusion protein with improved pharmacokinetic properties generated by fusing a bispecific single-chain diabody with an albumin-binding domain from streptococcal protein G. Protein Eng. Des. Sel. 20(11):569-76 (2007).
Strop. Veracity of microbial transglutaminase. Bioconjugate Chem. 25(5):855-862 (2014).
Studnicka et al. Human-engineered monoclonal antibodies retain full specific binding activity by preserving non-CDR complementarity-modulating residues. Pro Eng 7(6):805-814 (1994).
Su et al. PSMA specific single chain antibody-mediated targeted knockdown of Notch1 inhibits human prostate cancer cell proliferation and tumor growth. Cancer Lett. 338 (2): 282-291 (2013).
Tan et al. Influence of the hinge region on complement activation, C1q binding, and segmental flexibility in chimeric human immunoglobulins. PNAS USA 87:162-166 (1990).
Tan et al. "Superhumanized" antibodies: reduction of immunogenic potential by complementarity-determining region grafting with human germline sequences: application to an anti-CD28. J Immunol 169:1119-1125 (2002).
Tang et al. A human single-domain antibody elicits potent antitumor activity by targeting an epitope in mesothelin close to the cancer cell surface. Mol. Cancer Thera 12(4):416-426 (2013).

(56) References Cited

OTHER PUBLICATIONS

Tassev et al. Retargeting NK92 cells using an HLA-A2-restricted, EBNA3C-specific chimeric antigen receptor. Cancer Gene Ther 19(2):84-100 (2012).
Ten Berg et al. Selective expansion of a peripheral blood CD8+ memory T cell subset expressing both granzyme B and L-selectin during primary viral infection in renal allograft recipients. Transplant Proc 30(8):3975-3977 (1998).
Thomas et al. Mesothelin-specific CD8(+) T cell responses provide evidence of in vivo cross-priming by antigen-presenting cells in vaccinated pancreatic cancer patients. J Exp Med 200:297-306 (2004).
Tijink et al. Improved tumor targeting of anti-epidermal growth factor receptor nanobodies through albumin binding: taking advantage of modular Nanobody technology. Mol. Cancer Ther. 7(8):2288-97 (2008).
Tiller et al. Facile Affinity Maturation of Antibody Variable Domains Using Natural Diversity Mutagenesis. Front. Immunol. 8:986 (2017).
Tutt et al. Trispecific F(ab')3 derivatives that use cooperative signaling via the TCR/CD3 complex and CD2 to activate and redirect resting cytotoxic T cells. J Immunol. 147(1):60-69 (Jul. 1, 1991).
Ui-Tei et al. Sensitive assay of RNA interference in *Drosophila* and Chinese hamster cultured cells using firefly luciferase gene as target. Febs Letters 479: 79-82 (2000).
U.S. Appl. No. 15/160,984 Office Action dated Feb. 24, 2017.
U.S. Appl. No. 15/160,984 Office Action dated Sep. 22, 2016.
U.S. Appl. No. 15/600,264 Office Action dated Apr. 25, 2019.
U.S. Appl. No. 15/600,264 Office Action dated Apr. 26, 2018.
U.S. Appl. No. 15/600,264 Office Action dated Nov. 27, 2018.
U.S. Appl. No. 15/600,264 Office Action dated Oct. 3, 2017.
U.S. Appl. No. 15/600,582 Office Action dated Nov. 16, 2017.
U.S. Appl. No. 15/630,259 Office Action dated Dec. 30, 2019.
U.S. Appl. No. 15/630,259 Office Action dated Sep. 30, 2020.
U.S. Appl. No. 15/704,620 Office Action dated Oct. 26, 2017.
U.S. Appl. No. 15/821,498 Office Action dated Apr. 21, 2020.
U.S. Appl. No. 15/821,498 Office Action dated May 3, 2019.
U.S. Appl. No. 15/821,498 Office Action dated Oct. 26, 2018.
U.S. Appl. No. 15/821,530 Office Action dated Apr. 22, 2020.
U.S. Appl. No. 15/821,530 Office Action dated Apr. 3, 2019.
U.S. Appl. No. 15/821,530 Office Action dated Sep. 25, 2018.
U.S. Appl. No. 15/977,968 Office Action dated Feb. 21, 2019.
U.S. Appl. No. 15/977,988 Office Action dated Aug. 20, 2019.
U.S. Appl. No. 15/977,988 Office Action dated Mar. 26, 2019.
U.S. Appl. No. 15/977,988 Pre-Interview First Office Action dated Jan. 25, 2019.
U.S. Appl. No. 16/159,545 Office Action dated Aug. 6, 2019.
U.S. Appl. No. 16/159,545 Office Action dated Dec. 2, 2019.
U.S. Appl. No. 16/159,554 Office Action dated Jun. 7, 2019.
U.S. Appl. No. 16/159,554 Office Action dated Oct. 1, 2019.
U.S. Appl. No. 16/159,554 Office Action dated Oct. 5, 2020.
U.S. Appl. No. 16/583,070 Office Action dated Mar. 3, 2020.
Vajdos et al. Comprehensive functional maps of the antigen-binding site of an anti-ErbB2 antibody obtained with shotgun scanning mutagenesis. J Mol Biol 320:415-428 (2002).
Van Den Beuchken et al. Building novel binding ligands to B7.1 and B7.2 based on human antibody single variable light chain domains. J Mol biol 310:591-601 (2001).
Van Der Linden et al. Induction of immune responses and molecular cloning of the heavy chain antibody repertoire of Lama glama. J Immunol Methods 240:185-195 (2000).
Vaughan et al. Human antibodies by design. Nature Biotech 16:535-539 (1998).
Verhoeyen et al. Reshaping human antibodies: Grafting an antilysozyme activity. Science 239:1534-1536 (1988).
Verma et al. TCR mimic monoclonal antibody targets a specific peptide/HLA class I complex and significantly impedes tumor growth in vivo using breast cancer models. J Immunol 184(4):2156-2165 (2010).

Vincke et al. General strategy to humanize a camelid single-domain antibody and identification of a universal humanized nanobody scaffold. J. Biol. Chem. 284(5):3273-3284 (2009).
Wang et al. A New Recombinant Single Chain Trispecific Antibody Recruits T Lymphocytes to Kill CEA (Carcinoma Embryonic Antigen) Positive Tumor Cells In Vitro Efficiently. Journal of Biochemistry 135(4):555-565 (2004).
Willemsen et al. A phage display selected fab fragment with MHC class I-restricted specificity for MAGE-A1 allows for retargeting of primary human T lymphocytes. Gene Ther 8(21):1601-1608 (2001).
Winkler et al. Changing the antigen binding specificity by single point mutations of an anti-p24 (HIV-1) antibody. J Immunol. 165(8):4505-4514 (2000).
Wu et al. Humanization of a murine monoclonal antibody by simultaneous optimization of framework and CDR residues. J.Mol. Biol. 294:151-162 (1999).
Yan et al. Engineering upper hinge improves stability and effector function of a human IgG1. J. Biol. Chem. 287:5891 (2012).
Yee et al. Adoptive T cell therapy using antigen-specific CD8+ T cell clones for the treatment of patients with metastatic melanoma: in vivo persistence, migration, and antitumor effect of transferred T cells. PNAS USA 99(25):16168-16173 (2002).
Yoshinaga et al. Ig L-chain shuffling for affinity maturation of phage library-derived human anti-human MCP-1 antibody blocking its chemotactic activity. J Biochem 143(5):593-601 (2008).
Yu et al. Rationalization and design of the complementarity determining region sequences in an antibody-antigen recognition interface. PLoS One 7(3):e33340 (2012).
Zabetakis et al. Contributions of the complementarity determining regions to the thermal stability of a single-domain antibody. PLoS One 8(10):e77678 (2013).
Zare et al. Production of nanobodies against prostate-specific membrane antigen (PSMA) recognizing LnCaP cells. Int. J. Biol. Markers 29(2):e169-e179 (2014).
Zhang et al. New High Affinity Monoclonal Antibodies Recognize Non-Overlapping Epitopes on Mesothelin for Monitoring and Treating Mesothelioma. Sci Rep 5:9928 (2015).
Zhu et al. Combody: one-domain antibody multimer with improved avidity. Immunology and Cell Biology 88(6):667-675 (2010).
Chen et al. Preparation and characterization of dexamethasone acetate-loaded solid lipid nanoparticles. Chinese J Pharm 39(4):261-264 (2008) (English abstract).
Dondelinger et al., Understanding the Significance and Implications of Antibody Numbering and Antigen-Binding Surface/Residue Definition. Frontiers in Immunology 9(2278):1-15 (2018).
GenBank AHA34196.1, immunoglobulin variable heavy regionJIY-F10 RTA-F10, partial [Vicugna pacos] (Nov. 18, 2013).
Hu et al. Over-expression of human Notch ligand Delta-like 3 promotes proliferation of human gastric cancer cells in vitro. Nan Fang Yi Ke Da Xue Xue Bao 38(1):14-19 (2018) (English Abstract).
U.S. Appl. No. 17/165,760 Office Action dated Jan. 19, 2024.
U.S. Appl. No. 17/276,796 Office Action dated Feb. 1, 2024.
Zhao et al. Novel Antibody Therapeutics Targeting Mesothelin In Solid Tumors. Clin Cancer Drugs 3(2):76-86 (2016).
Jiang et al. Protritac: A protease cleavable T cell Engager Platform. Scientific Reports 6(Suppl 1):115 Available at https://calidibio.com/wp-content/uploads/2019/10/609-Abstract-_SITC-2018.pdf (2018).
Lin et al. ProTriTAC: A Protease-Activatable T Cell Engager Platform that Links Half-Life Extension to Functional Masking Society for Immunotherapy of Cancer (SITC) Annual Meeting. Nov. 2018, Available at https://www.harpoontx.com/file.cfm/43/docs/SITC_2018_ProTriTAC_Poster.pdf.
Balzar et al. Epidermal growth factor-like repeats mediate lateral and reciprocal interactions of Ep-CAM molecules in homophilic adhesions. Mol Cell Biol. 21(7):2570-80 (2001).
Balzar et al. The biology of the 17-1A antigen (Ep-CAM). J. Mol. Med. 77:699-712 (1999).
Brauchle et al. Characterization of a Novel FLT3 Bite Molecule for the Treatment of Acute Myeloid Leukemia. Mol Cancer Ther 19:1875-88 (2020).
Chaubal et al. Ep-CAM—a marker for the detection of disseminated tumor cells in patients suffering from SCCHN. Anticancer Res 19:2237-2242 (1999).

(56) References Cited

OTHER PUBLICATIONS

Eyvazi et al. Antibody Based EpCAM Targeted Therapy of Cancer, Review and Update. Curr Cancer Drug Targets. 18(9):857-868 (2018).
Gastl et al. Ep-CAM overexpression in breast cancer as a predictor of survival. Lancet. 356:1981-1982 (2000).
Goettlinger et al. The epithelial cell surface antigen 17-1A, a target for antibody-mediated tumor therapy: its biochemical nature, tissue distribution and recognition by different monoclonal antibodies. Int J Cancer. 38:47-53 (1986).
Julian et al. Efficient affinity maturation of antibody variable domains requires co-selection of compensatory mutations to maintain thermodynamic stability. Sci Rep 7:45259 (2017).
Kim et al. Strategies and 1-17 Advancement in Antibody-Drug Conjugate Optimization for Targeted Cancer Therapeutics. Biomol Ther (Seoul) 23(6):493-509 (2015).
Koprowski et al. Colorectal carcinoma antigens detected by hybridoma antibodies. Somatic Cell Genet. 5:957-971 (1979).
Krzywinska et al. CD45 Isoform Profile Identifies Natural Killer (NK) Subsets with Differential Activity. PLoS One 11(4):e0150434 (2016).
Leibl et al. Ovarian granulosa cell tumors frequently express EGFR (Her-1), Her-3, and Her-4: An immunohistochemical study. Gynecol Oncol 101(1):18-23 (2006).
Litvinov et al. Epithelial cell adhesion molecule (Ep-CAM) modulates cell-cell interactions mediated by classic cadherins. J Cell Biol. 139:1337-1348 (1997).
Litvinov et al. Expression of Ep-CAM in cervical squamous epithelia correlates with an increased proliferation and the disappearance of markers for terminal differentiation. Am. J. Pathol. 148:865-75 (1996).
Lucchi et al. The Masking Game: Design of Activatable Antibodies and Mimetics for Selective Thera-peutics Cell Control. ACS Cent Sci 7(5):724-738 (2021).
Mason et al. CD79a: a novel marker for B-cell neoplasms in routinely processed tissue samples. Blood 86(4):1453-1459 (1995).
Osta et al. EpCAM is overexpressed in breast cancer and is a potential target for breast cancer gene therapy. Cancer Res 64:5818-24 (2004).
PCT/US2020/060184 International Search Report and Written Opinion dated Mar. 4, 2021.
Piyathilake et al. The expression of Ep-CAM (17-1A) in squamous cell cancers of the lung. Hum Pathol. 31:482-487 (2000).
Poczatek et al. Ep-Cam levels in prostatic adenocarcinoma and prostatic intraepithelial neoplasia. J Urol. 162:1462-1464 (1999).
Quak et al. Production of a monoclonal antibody (K 931) to a squamous cell carcinoma associated antigen identified as the 17-1A antigen. Hybridoma 9:377-387 (1990).
Sandler et al. Nondermatologic adverse events associated with anti-EGFR therapy. Oncology (Williston Park) 20(5 Suppl 2):35-40 (2006).
Sheng et al. Novel Transgenic Mouse Model for Studying Human Serum Albumin as a Biomarker of Carcinogenic Exposure. Chem. Res. Toxicol. 29(5):797-809 (2016).
Simon et al. Epithelial glycoprotein is a member of a family of epithelial cell surface antigens homologous to nidogen, a matrix adhesion protein. PNAS USA 87:2755-2759 (1990).
Stehle et al. Albumin-based drug carriers: comparison between serum albumins of different species on pharmacokinetics and tumor uptake of the conjugate. Anticancer Drugs. 10(8):785-90 (1999).
Stirewalt et al. The role of FLT3 in haematopoietic malignancies. Nat Rev Cancer 3:650-665 (2003).
Thomas. Cetuximab: adverse event profile and recommendations for toxicity management. Clin J Oncol Nurs. 9(3):332-8 (2005).
Trail et al. Antibody drug 1-17 conjugates for treatment of breast cancer: Novel targets and diverse approaches in ADC design. Pharmacol Ther 181:126-142 (2018).
Trebak et al. Oligomeric state of the colon carcinoma-associated glycoprotein GA733-2 (Ep-CAM/EGP40) and its role in GA733-mediated homotypic cell-cell adhesion. J Biol Chem. 276:2299-2309 (2001).
U.S. Appl. No. 16/159,554 Office Action dated Mar. 16, 2021.
Lin, S.. Jack et al., ProTriTAC: A Protease-Activatable T Cell Engager Platform that Links Half-Life Extension to Functional Masking Society for Immunotherapy of Cancer, (SITC) Annual Meeting, Abstract P608, 2 pages, 2018.
Lucchi, Roberta et al., The Masking Game: Design of Activatable Antibodies and Mimetics for Selective Therapeutics and Cell Control, ACS Cent. Sci., 7, 724-738, 2021.

* cited by examiner

FIG. 4
A.
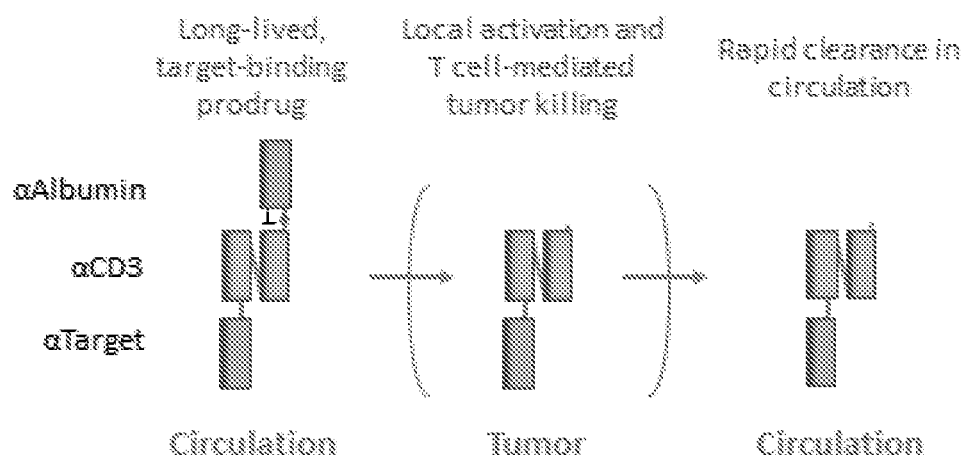
B.
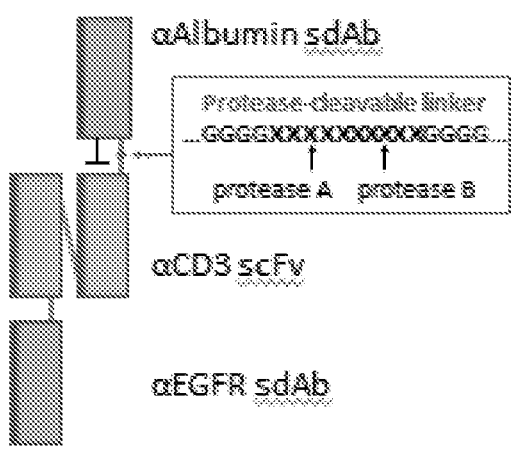
C.
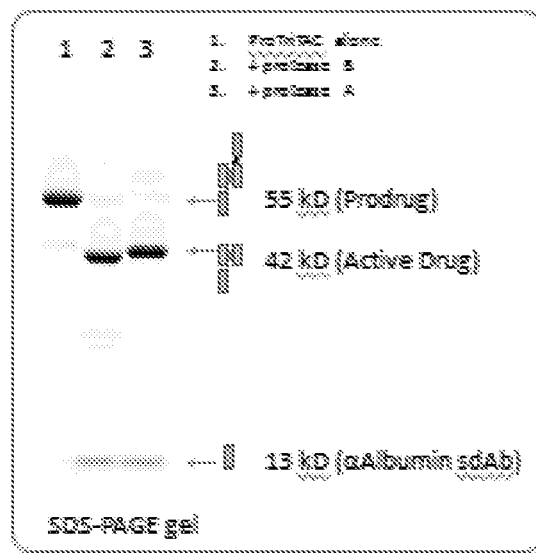

| Condition | % HMW | % Main | % LMW |
|---|---|---|---|
| T0 | 1.7 | 96.0 | 2.3 |
| 5x FT | 1.6 | 97.0 | 1.4 |
| 37C 1w | 2.6 | 95.4 | 2.0 |

250x CD3 Binding Differential in ELISA

>1000x Human Primary T Cell Binding Differential in Flow Cytometry

550x Functional Differential in T Cell Killing Assay

Linking Half-Life Extension with Functional Masking
(Generic)

Linking Half-Life Extension with Functional Masking
(T cell engager)

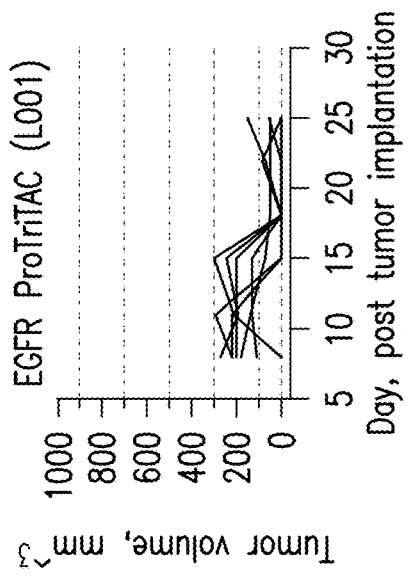
FIG. 20A
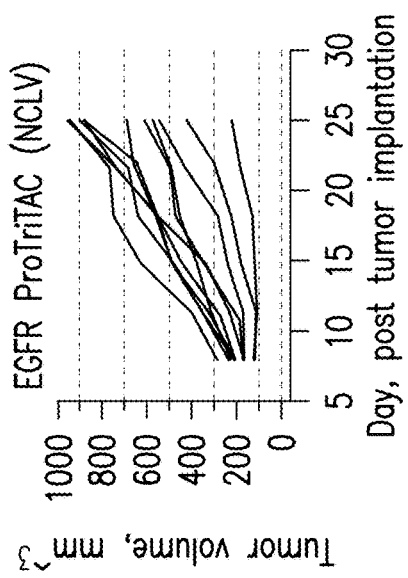
FIG. 20B
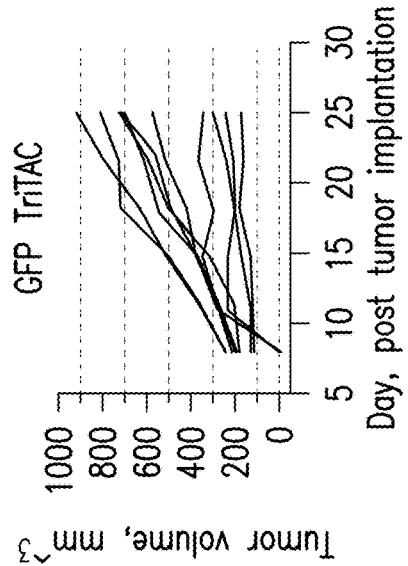
FIG. 20C
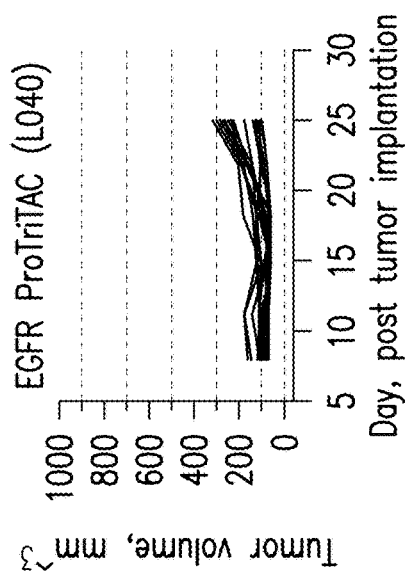
FIG. 20E
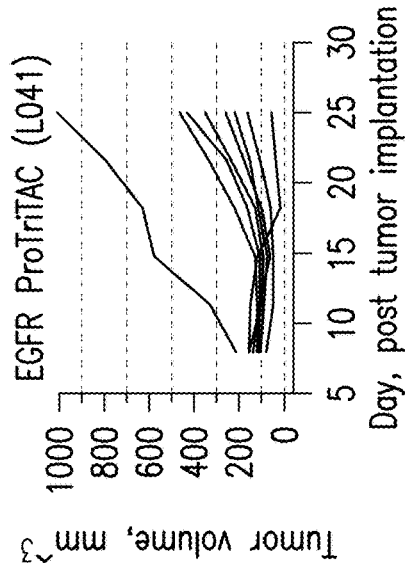
FIG. 20F

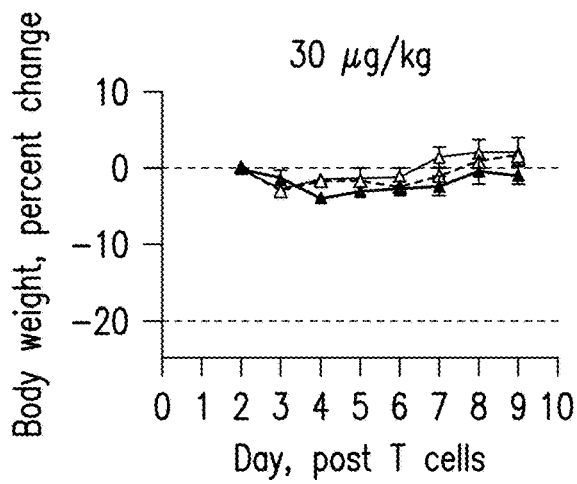
FIG.22A
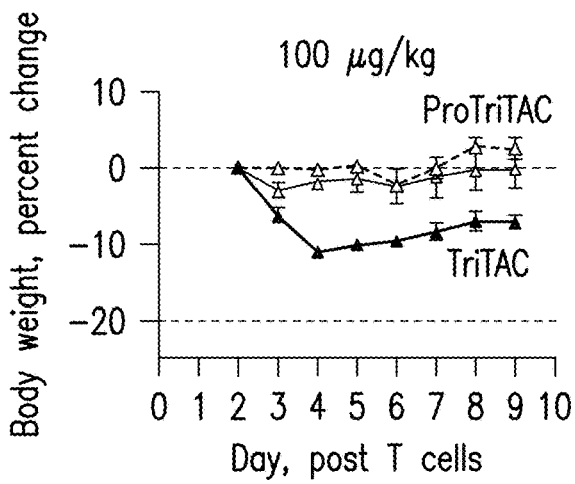
FIG.22B
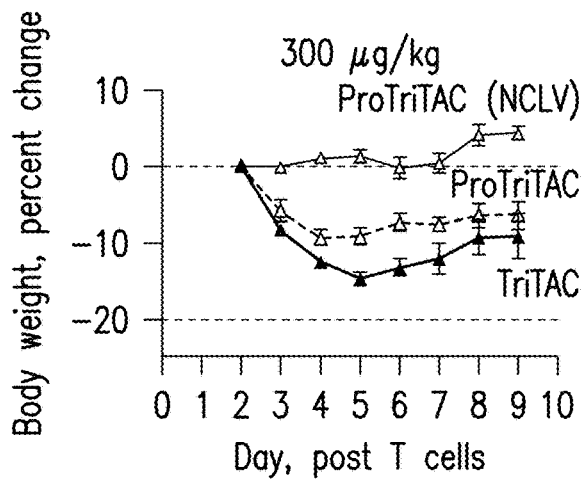
FIG.22C
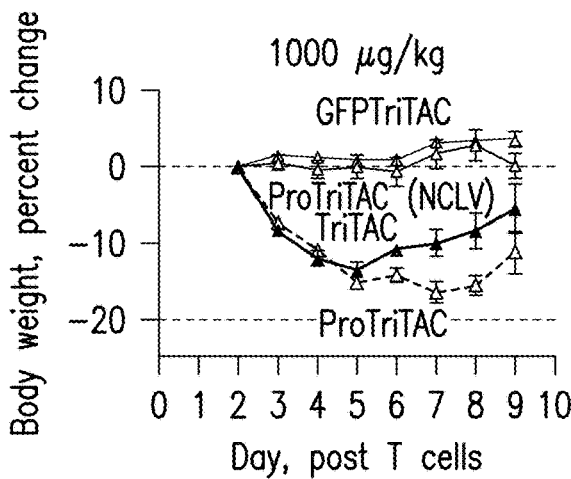
FIG.22D
| Dose Level (μg/kg) | TriTAC | ProTriTAC (L001) | ProTriTAC (NCLV) |
|---|---|---|---|
| 30<br>100<br>300<br>1000 | ✓ | ✓<br>✓ | ✓<br>✓<br>✓<br>✓ |
| Fold Protection | – | 3X | ≥30X |
FIG.22E

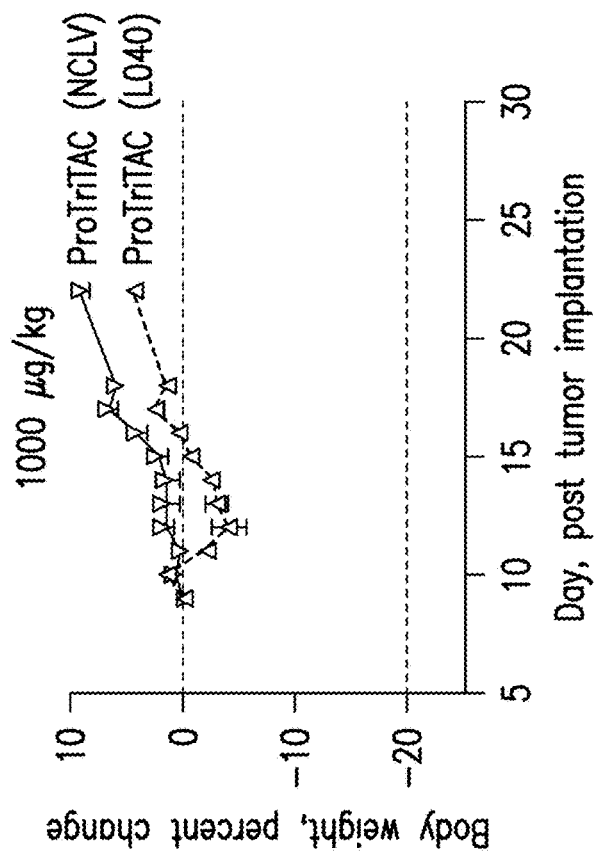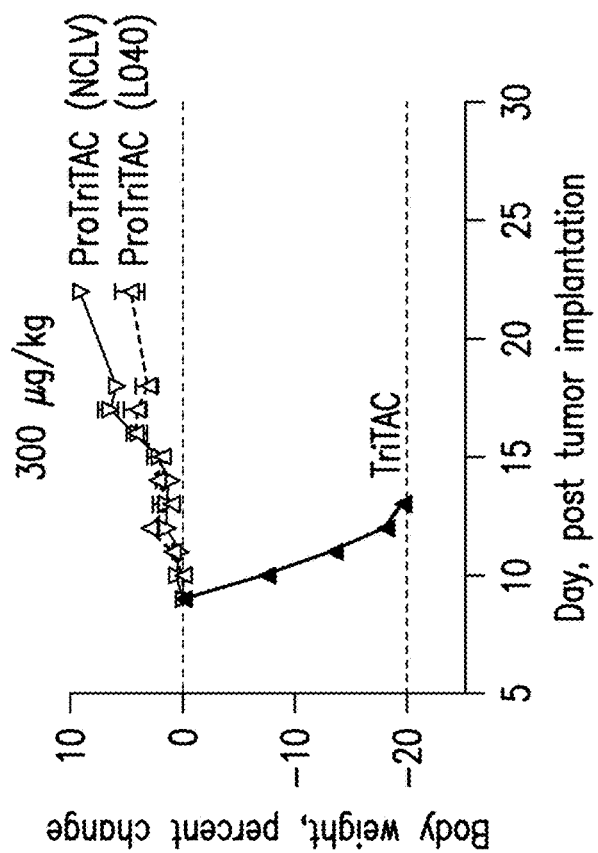

FIG. 27C
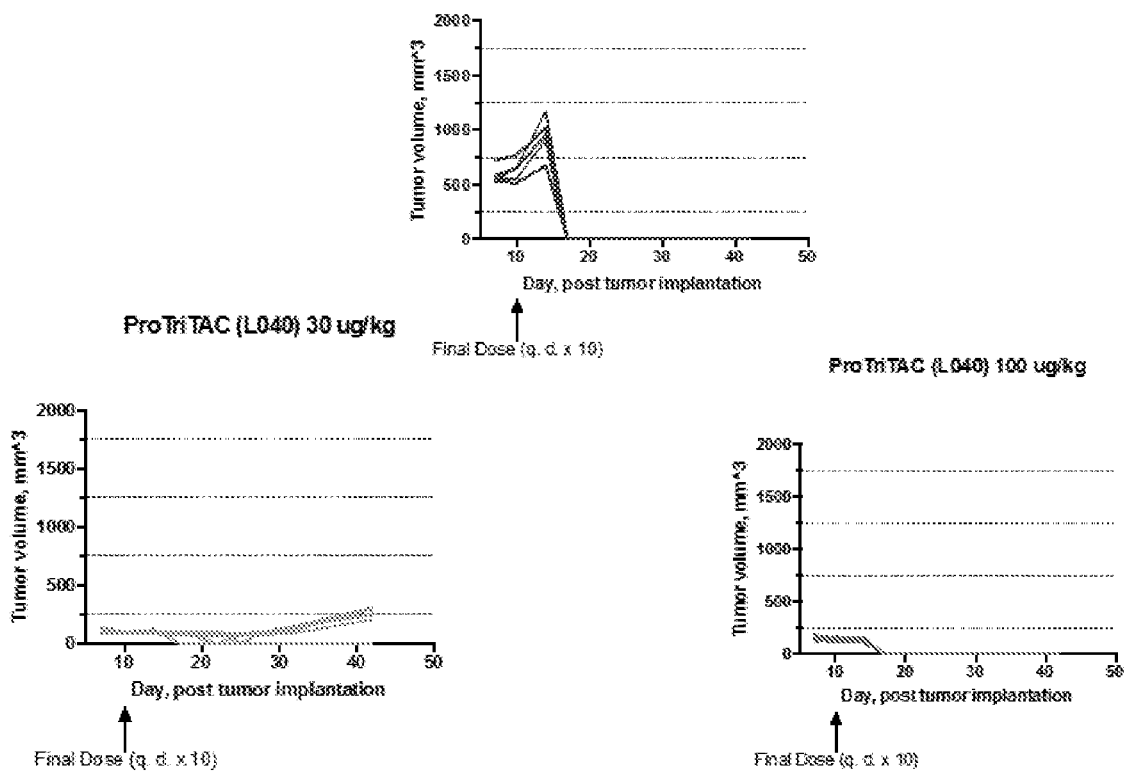
FIG. 27D
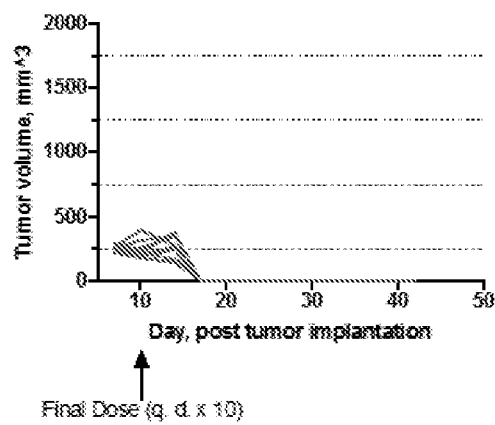
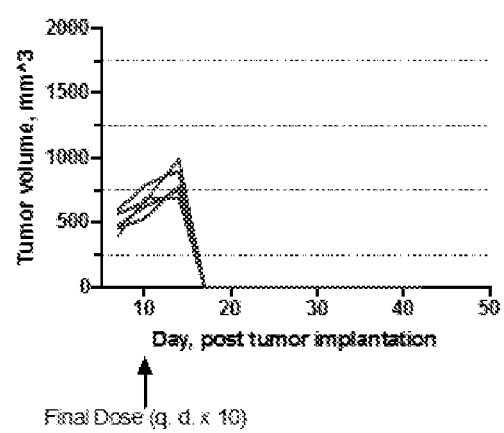

FIG. 29

Alternate Parallel Approach: Grafting aCD3 Epitope into CC' Loop to Compete for Binding to Adjacent aCD3 scFv HuCD3e    QDGNEEMGGITQ...

WT:       APGKG
CC10:     GGQDGNEEGG
CC12:     GGQDGNEEMGGG
CC16:     GGGGQDGNEEMGGGGG aALB
aCD3
aEGFR

FIG. 30

All ProTriTAC Candidates Were Tested with or without Pre-activation Using the Tumor-Associated Protease Matriptase ProTriTAC Candidates aCD3 (VH-VL): WT, CC10, CC12, CC16
aCD3 (VL-VH): WT, CC10, CC12, CC16

Regular TriTAC Controls: EGFR, GFP

— ProTriTAC
— Activated
— Free aALB

Matriptase total masking = steric masking + specific masking

FIG. 33
Systematically Exploring Non-CDR Loops by Library Mutagenesis to Engineer Bifunctional Inhibitory aALB sdAb
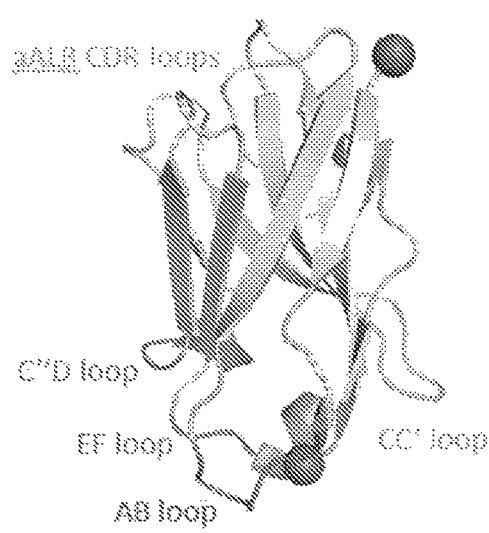
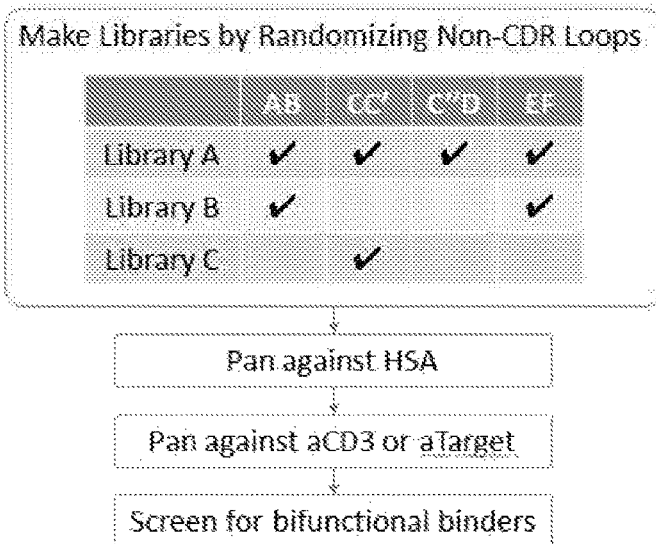

Soft Library Mutagenesis Identified CC' Loop as Most
Amenable to Modification

Naive Library

| AB | CC' | C''D | EF |
|---|---|---|---|
| LVQPGN------ | APGKG----- | DSVKGR----- | SLRPED---- |
| CFCXLCFR---- | STQDM----- | DSVKGR----- | SLRPED---- |
| LVQPGN------ | KQHSN----- | DSVKGR----- | SLRPED---- |
| IVLYEW------ | *APLV----- | SSMIQM----- | SLRPED---- |
| CFMCYW------ | DMWGANCS-- | DSVKGR----- | SLRPED---- |
| FYLAWAA----- | INVGSPAY-- | DSVKGR----- | SLHPED---- |
| GLSNRSGC---- | CSVGISRQ-- | LLLIFKF---- | LMRI*MX--- |
| FFNSEQF*---- | APGKG----- | FLILALTKP-- | QLMI*HFI-- |
| LVQPGN------ | LRGGLHRV-- | SKWACG----- | SVS-------- |
| VYMFNLVD---- | QLETPC---- | NYRWISL---- | SLRPED---- |
| LVQPGN------ | APGKG----- | SVLFGVAYL-- | SLRPED---- |
| FGPYNLVS---- | KLSTIWM--- | MRRPCVIS--- | VPSYRVA---- |
| *F*IC*------ | DSGLTLR--- | LLWHWD----- | VTEMNAMS-- |
| GXTDGGT----- | FLIXF*X--- | DSVKGR----- | LKRTVY---- |
| SICIVSFY---- | TNTAS----- | RGLIDNDYQ-- | SPD*RQYSV- |
| LSRPXX------ | CPPAIMP--- | DSVKGL----- | SLRPED---- |
| FALQCPXL---- | IVGN*T---- | LINLITE---- | SLCPED---- |
| S*MSMSLF---- | NVTL*WV--- | SDNILY----- | SLRPED---- |
| GF*IDVFIC--- | ISLPVMS--- | TPRTPTRP--- | SLRPED---- |
| LFQPGN------ | LYEPRAE--- | FLCFDLQ---- | *FLM*Y---- |
| HY*RISAM---- | YGNNCVLX-- | VARAYD----- | YRNHNRN--- |
| LVQ*GN------ | A*GKG----- | DSV*GR----- | SLR*ED---- |
| LVQPGN------ | APGKG----- | *VACGR----- | NTTAR*C--- |
| MLTGFPFG---- | *EIWW----- | DSVKGR----- | SLRPED---- |

CC' loop tolerates diverse sequence
compositions and lengths

After panning with HSA

| AB | CC' | C''D | EF |
|---|---|---|---|
| LVQPGN----- | YKEWD----- | DSVKGR---- | SLRPED-- |
| LVQPGN----- | APGKG----- | DSDKGR---- | SLPPQD-- |
| LVQPGN----- | ARR*G----- | DSVKGR---- | SLRPED-- |
| GLINSIA---- | RGSEGG---- | DSVKGR---- | SLRPED-- |
| LVQPGN----- | APGKG----- | DSVKGR---- | SLRPED-- |
| LVQPGN----- | XLHCGS---- | DSVKGR---- | SLRPED-- |
| LVQPGN----- | LTNTS----- | RPG*GLG--- | SLRPED-- |
| LVQPGN----- | APGKG----- | GAYFTGR--- | SLRPED-- |
| LVQPGN----- | KQQSHIM--- | DSVKGR---- | SLRPED-- |
| LVQPGN----- | LPXMKR---- | DSVKGR---- | SLRPED-- |
| LVQPGN----- | VGHPK----- | DSVKGR---- | SLRPED-- |
| LVQPGN----- | APGKG----- | DSVKGR---- | SLRPED-- |
| LVQPGN----- | TVTTP----- | DSVKGR---- | SLRPED-- |
| LVQPGN----- | SNSLNS---- | DSVKGR---- | SLRPED-- |
| LVQPGN----- | TSSRT----- | DSVKGR---- | FPNKAIN* |
| LVQPGN----- | SNSLNS---- | DSVKGR---- | SLRPED-- |
| LVQPGN----- | VANLY----- | DSVKGR---- | SLRPED-- |
| LVQPGN----- | SEAKT----- | DSVKGR---- | SLRPED-- |
| LVQPGN----- | APGEG----- | DSVKGR---- | SLRPED-- |
| LVQPGN----- | NMIRYPK--- | DSVKGR---- | SLRPED-- |
| LVQPGN----- | APGKG----- | DSVKGR---- | SLRPED-- |
| VAVLRGE---- | RALNL----- | DSVKGR---- | SLRPED-- |
| AAADNGV---- | APGKG----- | DSVKGR---- | SLRPED-- |
| LVQPGN----- | TSRNG----- | DSVKGR---- | SLRPED-- |
| LVQPGN----- | TNLSY----- | DSVKGR---- | SLRPED-- |
| LVQPGN----- | VKKSQNS--- | DSVKGR---- | SLRPED-- |
| LVQPGN----- | ADDRTH---- | YSVKGR---- | SLRPED-- |
| LVQPGN----- | APGKG----- | DSVKGR---- | SLRPED-- |
| LVQPGN----- | APNXV----- | *SADXG---- | SXNPQD-- |
| PGGEGX----- | XSISP----- | DSVKGR---- | SLPPED-- |

(LVQPGN) (APGKG) (DSVKGR) (SLRPED)

WT seqs

FIG.34

BINDING MOIETY FOR CONDITIONAL ACTIVATION OF IMMUNOGLOBULIN MOLECULES

CROSS-REFERENCE

This application is the U.S. National Stage Application of International Application No. PCT/US2019/032307, filed May 14, 2019, and claims the benefit of U.S. Provisional Application Nos. 62/671,344, filed May 14, 2018; 62/671,349, filed May 14, 2018; 62/756,429, filed Nov. 6, 2018; and 62/756,453 filed Nov. 6, 2018, all of which are incorporated by reference herein in their entirety.

INCORPORATION BY REFERENCE

All publications, patents, and patent applications mentioned in this specification are herein incorporated by reference to the same extent as if each individual publication, patent, or patent application was specifically and individually indicated to be incorporated by reference, and as if set forth in their entireties.

SEQUENCE LISTING

The instant application contains a Sequence Listing which has been submitted electronically in ASCII format and is hereby incorporated by reference in its entirety. Said ASCII copy, created on Dec. 6, 2023, is named 47517-729_831_SL.txt and is 1,222,504 bytes in size.

BACKGROUND OF THE INVENTION

T cell engagers transiently tether T cells to tumor cells and mediate T cell-directed tumor killing. T cell engagers, such as blinatumomab (BLINCYTO®), have demonstrated clinical activity in several hematological malignancies. Adoption of T cell engagers in solid tumors is limited by the scarcity of tumor antigens with sufficient differential expression between tumor and normal tissue. T cell engagers that are preferentially active in the tumor microenvironment may enable the safe targeting of more solid tumor antigens.

There is a need to extend the half-life of a therapeutic, diagnostic, or imaging molecule in circulation and also improve its ability to reach its target within an intended location (e.g., a tumor cell) without non-specific binding.

SUMMARY OF THE INVENTION

One embodiment provides a binding moiety comprising a non-CDR loop and a cleavable linker, wherein the moiety is capable of masking the binding of binding molecule to its target, wherein the binding molecule comprises an immunoglobulin molecule or a non-immunoglobulin molecule. In some embodiments, the moiety is a natural peptide, a synthetic peptide, an engineered scaffold, or an engineered bulk serum protein. In some embodiments, the engineered scaffold comprises a sdAb, a scFv, a Fab, a VHH, a fibronectin type III domain, immunoglobulin-like scaffold, DARPin, cystine knot peptide, lipocalin, three-helix bundle scaffold, protein G-related albumin-binding module, or a DNA or RNA aptamer scaffold. In some embodiments, the moiety is capable of binding to a bulk serum protein. In some embodiments, the non-CDR loop is from a variable domain, a constant domain, a C1-set domain, a C2-set domain, an I-domain, or any combinations thereof. In some embodiments, the moiety further comprises complementarity determining regions (CDRs). In some embodiments, the moiety is capable of binding to the bulk serum protein. In some embodiments, the bulk serum protein is a half-life extending protein. In some embodiments, the bulk serum protein is albumin, transferrin, IgG1, IgG2, IgG4, IgG3, IgA monomer, Factor XIII, Fibrinogen, IgE, or pentameric IgM. In some embodiments, the bulk serum protein is albumin, transferrin, Factor XIII, or Fibrinogen. In some embodiments, the CDRs within the binding moiety provide binding site specific for the bulk serum protein. In some embodiments, the binding moiety is capable of masking the binding of the target antigen binding domain (such as an immunoglobulin molecule) or a non-immunoglobulin binding molecule to its target via specific intermolecular interactions between the binding moiety and the target antigen binding domain or the non-immunoglobulin binding moiety. In some embodiments, the non-CDR loop within the binding moiety provides a binding site specific for binding of the binding moiety to the target antigen binding domain (such as an immunoglobulin molecule) or the non-immunoglobulin binding molecule.

In some embodiments, the binding moiety comprises a binding site specific for an immunoglobulin light chain. In some embodiments, the immunoglobulin light chain is an Igκ free light chain. In some embodiments, the CDRs provide the binding site specific for the bulk serum protein or the immunoglobulin light chain. In some embodiments, the immunoglobulin molecule is a target antigen binding domain. In some embodiments, the moiety is bound to the target antigen binding domain. In some embodiments, the moiety is covalently linked to the target antigen binding domain. In some embodiments, the moiety is capable of masking the binding of the target antigen binding domain to its target via specific intermolecular interactions between the binding moiety and the target antigen binding domain. In some embodiments, the non-CDR loop provides a binding site specific for binding of the moiety to the target antigen binding domain. In some embodiments, upon cleavage of the cleavable linker, the binding moiety is separated from the target antigen binding domain and the target antigen binding domain binds to its target. In some embodiments, the target antigen domain binds to a tumor antigen. In some embodiments, the tumor antigen comprises EpCAM, EGFR, HER-2, HER-3, c-Met, FolR, PSMA, CD38, BCMA, and CEA. 5T4, AFP, B7-H3, CDH-6, CAIX, CD117, CD123, CD138, CD166, CD19, CD20, CD205, CD22, CD30, CD33, CD352, CD37, CD44, CD52, CD56, CD70, CD71, CD74, CD79b, DLL3, EphA2, FAP, FGFR2, FGFR3, GPC3, gpA33, FLT-3, gpNMB, HPV-16 E6, HPV-16 E7, ITGA2, ITGA3, SLC39A6, MAGE, mesothelin, Muc1, Muc16, NaPi2b, Nectin-4, CDH-3, CDH-17, EPHB2, ITGAV, ITGB6, NY-ESO-1, PRLR, PSCA, PTK7, ROR1, SLC44A4, SLITRK5, SLITRK6, STEAP1, TIM1, Trop2, or WT1. In some embodiments, the target antigen domain binds to an immune checkpoint protein. In some embodiments, the immune checkpoint protein is CD27, CD137, 2B4, TIGIT, CD155, ICOS, HVEM, CD40L, LIGHT, OX40, DNAM-1, PD-L1, PD1, PD-L2, CTLA-4, CD8, CD40, CEACAM1, CD48, CD70, A2AR, CD39, CD73, B7-H3, B7-H4, BTLA, IDO1, IDO2, TDO, KIR, LAG-3, TIM-3, or VISTA. In some embodiments, the target antigen binding domain binds to a T-cell. In some embodiments, the target antigen binding domain binds to CD3. In some embodiments, the cleavable linker comprises a cleavage site. In some embodiments, the cleavage site is recognized by a protease. In some embodiments, the protease cleavage site is recognized by a serine protease, a cysteine protease, an aspartate protease, a threonine protease, a glutamic acid protease, a metalloproteinase, a gelatinase, or a asparagine peptide lyase. In some embodiments, the protease cleavage site is recognized by a Cathepsin B, a Cathepsin C, a Cathepsin D, a Cathepsin E, a Cathepsin K, a Cathepsin L, a kallikrein, a hK1, a hK10, a hK15, a plasmin, a collagenase, a Type IV collagenase, a stromelysin, a Factor Xa, a chymotrypsin-like protease, a trypsin-like protease, a elastase-like protease, a subtilisin-like protease, an actinidain, a bromelain, a calpain, a caspase, a caspase-3, a Mir1-CP, a papain, a HIV-1 protease, a HSV protease, a CMV protease, a chymosin, a renin, a pepsin, a matriptase, a legumain, a plasmepsin, a nepenthesin, a metalloexopeptidase, a metalloendopeptidase, a matrix metalloprotease (MMP), a MMP1, a MMP2, a MMP3, a MMP7, a MMP8, a MMP9, a MMP10, a MMP11, a MMP12, a MMP13, a MMP14, an ADAM9, an ADAM10, an ADAM12, an urokinase plasminogen activator (uPA), an enterokinase, a prostate-specific target (PSA, hK3), an interleukin-1β converting enzyme, a thrombin, a FAP (FAP-α), a dipeptidyl peptidase, a type II transmembrane serine protease (TTSP), a neutrophil elastase, a cathepsin G, a proteinase 3, a neutrophil serine protease 4, a mast cell chymase, and a mast cell tryptase.

One embodiment provides a conditionally active binding protein comprising a binding moiety (M) which comprises a non-CDR loop, a cleavable linker (L), a first target antigen binding domain (T1), and a second target antigen binding domain (T2), wherein the first target antigen binding domain (T1) comprises an immunoglobulin molecule, wherein the non-CDR loop is capable of binding to the first target antigen binding domain, and wherein the binding moiety is capable of masking the binding of the first target antigen binding domain to its target. In some embodiments, the binding moiety is capable of binding to a half-life extending protein. In some embodiments, the binding moiety is a natural peptide, a synthetic peptide, an engineered scaffold, or an engineered serum bulk protein. In some embodiments, the engineered scaffold comprises a sdAb, a scFv, a Fab, a VHH, a fibronectin type III domain, immunoglobulin-like scaffold, DARPin, cystine knot peptide, lipocalin, three-helix bundle scaffold, protein G-related albumin-binding module, or a DNA or RNA aptamer scaffold. In some embodiments, the non-CDR loop is from a variable domain, a constant domain, a C1-set domain, a C2-set domain, an I-domain, or any combinations thereof. In some embodiments, the binding moiety further comprises complementarity determining regions (CDRs). In some embodiments, the binding moiety comprises a binding site specific for a bulk serum protein. In some embodiments, the bulk serum protein is albumin, transferrin, IgG1, IgG2, IgG4, IgG3, IgA monomer, Factor XIII, Fibrinogen, IgE, or pentameric IgM. In some embodiments, the binding moiety further comprises a binding site specific for an immunoglobulin light chain. In some embodiments, the immunoglobulin light chain is an Igκ free light chain. T In some embodiments, the CDRs provide the binding site specific for the bulk serum protein or the immunoglobulin light chain, or any combinations thereof. In some embodiments, the binding moiety is capable of masking the binding of the first target antigen binding domain to its target via specific intermolecular interactions between the binding moiety and the first target antigen binding domain. In some embodiments, the non-CDR loop provides a binding site specific for binding of the binding moiety to the first target antigen binding domain. In some embodiments, the first or the second target antigen binding domain binds to a tumor antigen). In some embodiments, the tumor antigen comprises at least one of: EpCAM (exemplary protein sequence comprises UniProtkB ID No. P16422), EGFR (exemplary protein sequence comprises UniProtkB ID No. P00533), HER-2(exemplary protein sequence comprises UniProtkB ID No. P04626), HER-3 (exemplary protein sequence comprises UniProtkB ID No. P21860), c-Met (exemplary protein sequence comprises UniProtkB ID No. P08581), FoIR (exemplary protein sequence comprises UniProtkB ID No. P15238), PSMA (exemplary protein sequence comprises UniProtkB ID No. Q04609), CD38 (exemplary protein sequence comprises UniProtkB ID No. P28907), BCMA (exemplary protein sequence comprises UniProtkB ID No. Q02223), and CEA (exemplary protein sequence comprises UniProtkB ID No. P06731, 5T4 (exemplary protein sequence comprises UniProtkB ID No. Q13641), AFP (exemplary protein sequence comprises UniProtkB ID No. P02771), B7-H3 (exemplary protein sequence comprises UniProtkB ID No. Q5ZPR3), CDH-6 (exemplary protein sequence comprises UniProtkB ID No. P97326), CAIX (exemplary protein sequence comprises UniProtkB ID No. Q16790), CD117 (exemplary protein sequence comprises UniProtkB ID No. P10721), CD123 (exemplary protein sequence comprises UniProtkB ID No. P26951), CD138 (exemplary protein sequence comprises UniProtkB ID No. P18827), CD166 (exemplary protein sequence comprises UniProtkB ID No. Q13740), CD19 (exemplary protein sequence comprises UniProtkB ID No. P15931), CD20 (exemplary protein sequence comprises UniProtkB ID No. P11836), CD205 (exemplary protein sequence comprises UniProtkB ID No. 060449), CD22 (exemplary protein sequence comprises UniProtkB ID No. P20273), CD30 (exemplary protein sequence comprises UniProtkB ID No. P28908), CD33 (exemplary protein sequence comprises UniProtkB ID No. P20138), CD352 (exemplary protein sequence comprises UniProtkB ID No. Q96DU3), CD37 (exemplary protein sequence comprises UniProtkB ID No. P11049), CD44 (exemplary protein sequence comprises UniProtkB ID No. P16070), CD52 (exemplary protein sequence comprises UniProtkB ID No. P31358), CD56 (exemplary protein sequence comprises UniProtkB ID No. P13591), CD70 (exemplary protein sequence comprises UniProtkB ID No. P32970), CD71 (exemplary protein sequence comprises UniProtkB ID No. P02786), CD74 (exemplary protein sequence comprises UniProtkB ID No. P04233), CD79b (exemplary protein sequence comprises UniProtkB ID No. P40259), DLL3 (exemplary protein sequence comprises UniProtkB ID No. Q9NYJ7), EphA2 (exemplary protein sequence comprises UniProtkB ID No. P29317), FAP (exemplary protein sequence comprises UniProtkB ID No. Q12884), FGFR2 (exemplary protein sequence comprises UniProtkB ID No. P21802), FGFR3 (exemplary protein sequence comprises UniProtkB ID No. P22607), GPC3 (exemplary protein sequence comprises UniProtkB ID No. P51654), gpA33 (exemplary protein sequence comprises UniProtkB ID No. Q99795), FLT-3 (exemplary protein sequence comprises UniProtkB ID No. P36888), gpNMB (exemplary protein sequence comprises UniProtkB ID No. Q14956), HPV-16 E6 (exemplary protein sequence comprises UniProtkB ID No. P03126), HPV-16 E7 (exemplary protein sequence comprises UniProtkB ID No. P03129), ITGA2 (exemplary protein sequence comprises UniProtkB ID No. P17301), ITGA3 (exemplary protein sequence comprises UniProtkB ID No. P26006), SLC39A6 (exemplary protein sequence comprises UniProtkB ID No. Q13433), MAGE (exemplary protein sequence comprises UniProtkB ID No. Q9HC15), mesothelin (exemplary protein sequence comprises UniProtkB ID No. Q13421), Muc1 (exemplary protein sequence comprises UniProtkB ID No. P15941), Muc16 (exemplary protein sequence comprises UniProtkB ID No. Q8WX17), NaPi2b (exemplary protein sequence comprises UniProtkB ID No. 095436), Nectin-4 (exemplary protein sequence comprises UniProtkB ID No. Q96918), CDH-3 (exemplary protein sequence comprises UniProtkB ID No. Q8WX17), CDH-17 (exemplary protein sequence comprises UniProtkB ID No. E5RJT3), EPHB2 (exemplary protein sequence comprises UniProtkB ID No. P29323), ITGAV (exemplary protein sequence comprises UniProtkB ID No. P06756), ITGB6 (exemplary protein sequence comprises UniProtkB ID No. P18564), NY-ESO-1 (exemplary protein sequence comprises UniProtkB ID No. P78358), PRLR (exemplary protein sequence comprises UniProtkB ID No. P16471), PSCA (exemplary protein sequence comprises UniProtkB ID No. 043653), PTK7 (exemplary protein sequence comprises UniProtkB ID No. Q13308), ROR1 (exemplary protein sequence comprises UniProtkB ID No. Q01973), SLC44A4 (exemplary protein sequence comprises UniProtkB ID No. Q53GD3), SLITRK5 (exemplary protein sequence comprises UniProtkB ID No. Q8IW52), SLITRK6 (exemplary protein sequence comprises UniProtkB ID No. Q9HY7), STEAP1 (exemplary protein sequence comprises UniProtkB ID No. Q9UHE8), TIM1 (exemplary protein sequence comprises UniProtkB ID No. Q96D42), Trop2 (exemplary protein sequence comprises UniProtkB ID No. P09758), or WT1 (exemplary protein sequence comprises UniProtkB ID No. P19544), or any combinations thereof. In some embodiments, the first or the second target antigen binding domain binds to an immune checkpoint protein. In some embodiments, the immune checkpoint protein is at least one of: CD27 (exemplary protein sequence comprises UniProtkB ID No. P26842), CD137 (exemplary protein sequence comprises UniProtkB ID No. Q07011), 2B4 (exemplary protein sequence comprises UniProtkB ID No. Q9bZW8), TIGIT (exemplary protein sequence comprises UniProtkB ID No. Q495A1), CD155 (exemplary protein sequence comprises UniProtkB ID No. P15151), ICOS (exemplary protein sequence comprises UniProtkB ID No. Q9Y6W8), HVEM (exemplary protein sequence comprises UniProtkB ID No. 043557), CD40L (exemplary protein sequence comprises UniProtkB ID No. P29965), LIGHT (exemplary protein sequence comprises UniProtkB ID No. 043557), OX40 (exemplary protein sequence comprises UniProtkB ID No.), DNAM-1 (exemplary protein sequence comprises UniProtkB ID No. Q15762), PD-L1 (exemplary protein sequence comprises UniProtkB ID No. Q9ZQ7), PD1 (exemplary protein sequence comprises UniProtkB ID No. Q15116), PD-L2 (exemplary protein sequence comprises UniProtkB ID No. Q9BQ51), CTLA-4 (exemplary protein sequence comprises UniProtkB ID No. P16410), CD8 (exemplary protein sequence comprises UniProtkB ID No. P10966, P01732), CD40 (exemplary protein sequence comprises UniProtkB ID No. P25942), CEACAM1 (exemplary protein sequence comprises UniProtkB ID No. P13688), CD48 (exemplary protein sequence comprises UniProtkB ID No. P09326), CD70 (exemplary protein sequence comprises UniProtkB ID No. P32970), AA2AR (exemplary protein sequence comprises UniProtkB ID No. P29274), CD39 (exemplary protein sequence comprises UniProtkB ID No. P49961), CD73 (exemplary protein sequence comprises UniProtkB ID No. P21589), B7-H3 (exemplary protein sequence comprises UniProtkB ID No. Q5ZPR3), B7-H4 (exemplary protein sequence comprises UniProtkB ID No. Q7Z7D3), BTLA (exemplary protein sequence comprises UniProtkB ID No. Q76A9), IDO1 (exemplary protein sequence comprises UniProtkB ID No. P14902), IDO2 (exemplary protein sequence comprises UniProtkB ID No. Q6ZQW0), TDO (exemplary protein sequence comprises UniProtkB ID No. P48755), KIR (exemplary protein sequence comprises UniProtkB ID No. Q99706), LAG-3 (exemplary protein sequence comprises UniProtkB ID No. P18627), TIM-3 (also known as HAVCR2, exemplary protein sequence comprises UniProtkB ID No. Q8TDQ0), or VISTA (exemplary protein sequence comprises UniProtkB ID No. Q9D659). In some embodiments, the first or the second target antigen binding domain binds to an immune cell.

In some embodiments, the first or the second target antigen binding domain binds to a T-cell. In some embodiments, the first or the second target antigen binding domain binds to CD3. In some embodiments, the binding moiety (M), the cleavable linker (L), the first target antigen binding domain (T1), and the second target antigen binding domain (T2) are in one of the following configurations: M:L:T1:T2, and T2:T1:L:M. In some embodiments, the binding moiety comprises an albumin binding domain (anti-Alb), the first target antigen binding domain (T1) comprises a CD3 binding domain (e.g., an anti-CD3 scFV), and a ProTriTAC molecule has the following orientation: anti-Alb: anti-CD3: T2. In some embodiments, the binding moiety comprises an albumin binding domain (anti-Alb), the second target antigen binding domain (T2) comprises a CD3 binding domain (e.g., an anti-CD3 scFV), and a ProTriTAC molecule has the following orientation: anti-Alb: T1: anti-CD3. The T1 domain, in certain examples, is a tumor antigen binding domain, such as, but not limited to, an anti-EGFR domain, an anti-MSLN domain, an anti-BCMA domain, an anti-EpCAM domain, an anti-PSMA domain, or an anti-DLL3 domain.

In some embodiments, the cleavable linker comprises a cleavage site. In some embodiments, the cleavage site is recognized by a protease. In some embodiments, the protease cleavage site is recognized by a serine protease, a cysteine protease, an aspartate protease, a threonine protease, a glutamic acid protease, a metalloproteinase, a gelatinase, or an asparagine peptide lyase. In some embodiments, the protease cleavage site is recognized by a Cathepsin B, a Cathepsin C, a Cathepsin D, a Cathepsin E, a Cathepsin K, a Cathepsin L, a kallikrein, a hK1, a hK10, a hK15, a plasmin, a collagenase, a Type IV collagenase, a stromelysin, a Factor Xa, a chymotrypsin-like protease, a trypsin-like protease, a elastase-like protease, a subtilisin-like protease, an actinidain, a bromelain, a calpain, a caspase, a caspase-3, a Mir1-CP, a papain, a HIV-1 protease, a HSV protease, a CMV protease, a chymosin, a renin, a pepsin, a matriptase, a legumain, a plasmepsin, a nepenthesin, a metalloexopeptidase, a metalloendopeptidase, a matrix metalloprotease (MMP), a MMP1, a MMP2, a MMP3, a MMP7, a MMP8, a MMP9, a MMP10, a MMP11, a MMP12, a MMP13, a MMP14, an ADAM9, an ADAM10, an ADAM12, an urokinase plasminogen activator (uPA), an enterokinase, a prostate-specific target (PSA, hK3), an interleukin-1β converting enzyme, a thrombin, a FAP (FAP-α), a dipeptidyl peptidase, a type II transmembrane serine protease (TTSP), a neutrophil elastase, a cathepsin G, a proteinase 3, a neutrophil serine protease 4, a mast cell chymase, and a mast cell tryptase. In some embodiments, the conditionally active protein further comprises a half-life extension domain bound to the binding moiety, wherein the half-life extension domain provides the binding protein with a safety switch, and wherein upon cleavage of the linker the binding protein is activated by separation of the binding moiety and the half-life extension domain from the first target antigen binding domain, and the binding protein is thereby separated from the safety switch. In some embodiments, the cleavage of the linker is in a tumor microenvironment.

One embodiment provides a conditionally active binding protein, comprising a binding moiety linked to a target antigen binding domain via a non-CDR loop within the binding moiety, wherein the binding moiety is further linked to a half-life extension domain and comprises a cleavable linker, wherein the target antigen binding domain comprises an immunoglobulin molecule, wherein the binding protein has an extended half-life prior to its activation by cleavage of the linker, and wherein upon activation the binding moiety and the half-life extension domain are separated from the target antigen binding domain, and wherein the binding protein, in its activated state, does not have an extended half-life. In some embodiments, the cleavage of the linker is in a tumor microenvironment.

In some embodiments, the non-CDR loop comprises a CC' loop of at least one of: a camelid VHH domain, a human VH domain, a humanized VH domain, or a single domain antibody. In some embodiments, the binding moiety comprises a binding site specific for a CD3e domain, and wherein the binding site for the CD3e domain comprises at least one of the following motifs: QDGNE (SEQ ID NO: 921), QDGNEE (SEQ ID NO: 801), DGNE (SEQ ID NO: 922), and DGNEE (SEQ ID NO: 923).

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which.

FIG. 2A: Version 1. FIG. 2B: Version 2.

FIGS. 4A-4C show activation and possible mode of action of trispecific molecules (ProTriTAC). FIG. 4A shows ProTriTAC molecules in circulation, in tumor environment, and in circulation. FIG. 4B shows an exemplary sequence (SEQ ID NO: 929) for the protease cleavable site in a linker tethered to an anti-albumin binding moiety and FIG. 4C shows an SDS-PAGE gel showing the ProTriTAC in its activatable (prodrug) and activated (active drug) states.

FIGS. 5A-B illustrate a process for making and purifying molecules described herein.

FIG. 5A shows a schematic flowchart for manufacturing a ProTriTAC molecule and FIG. 5C shows an SDS-PAGE gel showing three purified ProTriTAC molecules.

FIG. 6B provides the data for FIG. 6A.

FIG. 8A: Control #1; FIG. 8B: Control #2; FIG. 8C: ProTriTAC; and FIG. 8D: Activated ProTriTAC.

FIG. 16A shows a ProDrug molecule comprising an anti-albumin moiety which includes a masking moiety, and a cleavable linker connecting the anti-albumin moiety and the drug. FIG. 16B shows a ProDrug molecule comprising an anti-albumin moiety comprising two peptide motifs linked by linker, one of which includes a masking moiety, and a cleavable linker connecting the albumin binding moiety to a drug. FIG. 16C shows a ProDrug molecule comprising a modified albumin (containing a masking moiety) linked to a drug by a cleavable linker. FIG. 16D shows a ProDrug molecule comprising a modified albumin (containing a masking moiety and a protease cleavage site) linked to a drug. FIG. 16E shows an activated ProDrug. In each schematic structure (FIGS. 16A-16D) the drug molecule is functionally masked by the anti-albumin moiety or the modified albumin from binding its target or from being activated at an undesired site or from binding at non-target sites and thereby creating a drug sink.

FIG. 17A shows a ProTriTAC molecule comprising an anti-albumin moiety which includes a masking moiety, and a cleavable linker connecting the anti-albumin moiety and a T cell engager molecule. FIG. 17B shows a ProTriTAC molecule comprising an anti-albumin moiety comprising two peptide motifs linked by linker, one of which includes a masking moiety, and a cleavable linker connecting the albumin binding moiety to a T cell engager molecule. FIG. 17C shows a ProTriTAC molecule comprising a modified albumin (containing a masking moiety) linked to a T cell engager by a cleavable linker. FIG. 17D shows a ProTriTAC molecule comprising a modified albumin (containing a masking moiety and a protease cleavage site) linked to a T cell engager. FIG. 17E shows an activated ProTriTAC. In each schematic structure (FIGS. 17A-17D) a target binding interface within the ProTriTAC molecule is functionally masked by the anti-albumin moiety or the modified albumin from binding its target or from being activated at an undesired site or from binding at non-target sites and thereby creating a sink.

FIGS. 20A-20F show admix xenograft individual tumor volumes following administering exemplary ProTriTAC molecules or TriTAC molecules of this disclosure. FIG. 20A illustrates results from a GFP TriTAC. FIG. 20B. illustrates results from EGFR ProTriTAC (NCLV). FIG. 20C illustrates results from EGFR ProTriTAC (L001). FIG. 20D illustrates results from EGFR ProTriTAC (L041). FIG. 20E illustrates results from EGFR ProTriTAC (L040). FIG. 20F illustrates results from EGFR ProTriTAC (L045).

FIG. 21C) following administering exemplary ProTriTAC molecules or TriTAC molecules of this disclosure.

FIGS. 22A-22E show body weight percent change in mice, following administering exemplary ProTriTAC molecules and TriTAC molecules of this disclosure. FIG. 22A illustrates results of 30 µg/kg; FIG. 22B illustrates results of 100 µg/kg; FIG. 22C illustrates results of 300 µg/kg; FIG. 22D illustrates results of 1000 µg/kg; and FIG. 22E provides fold protection at the various concentrations.

FIGS. 23A-23C show body weight percent change in mice, following administering varying concentrations of exemplary ProTriTAC molecules of this disclosure, containing non-cleavable or cleavable linkers. FIG. 23A illustrates results of 300 µg/kg; FIG. 23B illustrates results of 1000 µg/kg; FIG. 23C provides fold protection at the various concentrations.

FIG. 26B) or AST (left panel; FIB. 26A), in cynomolgus monkeys, following administering varying concentrations of an EGFR ProTriTAC molecule, or an EGFR ProTriTAC (NCLV) molecule.

FIGS. 27A-27D show tumor volume in mice following administration of a GFP TriTAC molecule, an EGFR TriTAC molecule, or an EGFR ProTriTAC molecule, in varying concentrations. FIG. 27A shows GFP TriTAC (at 300 µg/kg) and an EGFR TriTAC (at 10 µg/kg). FIG. 27B shows the EGFR TriTAC (at 30 µg/kg and at 100 µg/kg). FIG. 27C shows the EGFR TriTAC (at 300 µg/kg) and an EGFR ProTriTAC (at 30 µg/kg and 100 µg/kg). FIG. 27D shows the EGFR ProTriTAC (at 300 µg/kg and 1000 µg/kg)

FIG. 29 shows grafting of a CD36 epitope into the CC' loop of a binding moiety of this disclosure. HuCD3e: SEQ ID NO: 902; CC10: SEQ ID NO: 260; CC12: SEQ ID NO: 259; and CC16: SEQ ID NO: 261. WT disclosed as SEQ ID NO: 795.

FIG. 30 shows separation of a binding moiety of this disclosure, from a ProTriTAC molecule that contained the binding moiety, upon tumor associated protease activation by matriptase.

FIG. 33 shows the soft library mutagenesis approach carried out to explore the non-CDR loops within an exemplary binding moiety of this disclosure.

FIG. 34 illustrates the results of the soft library mutagenesis approach carried out to explore the non-CDR loops within an exemplary binding moiety of this disclosure, after panning against HSA (human serum albumin or also referred to herein as albumin). Figure discloses "Naïve Library" sequences as SEQ ID NOS 930-1018, respectively, in order of appearance and discloses "After panning with HSA" sequences as SEQ ID NOS 1019-1140, respectively, in order of appearance.

DETAILED DESCRIPTION OF THE INVENTION

Figure 1:
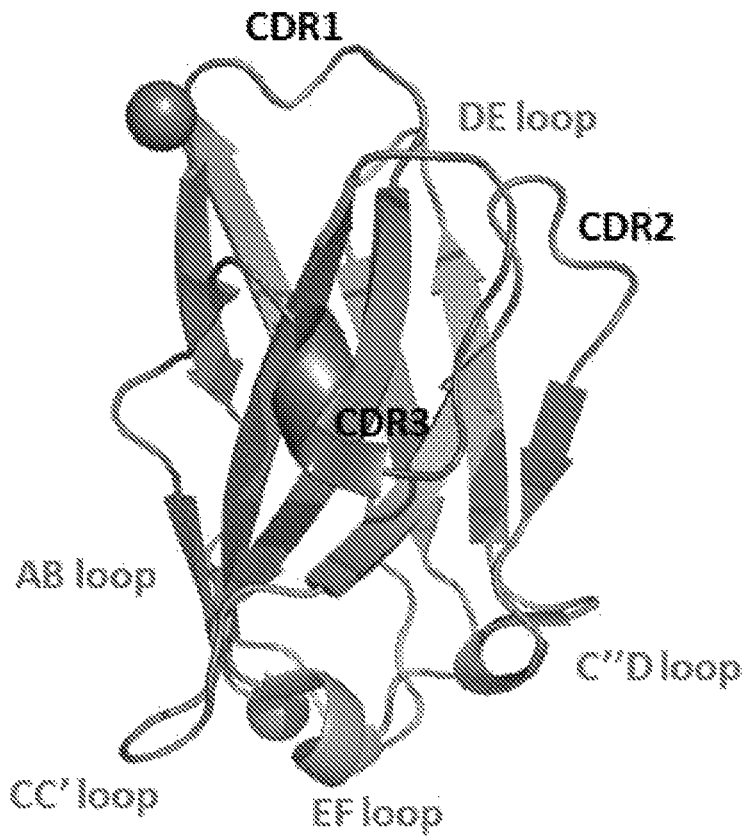
FIG. 1 illustrates a variable domain of an exemplary immunoglobulin domain, comprising complementarity determining regions (CDR1, CDR2, and CDR3), and non-CDR loops connecting the beta strand (AB, CC', C" D, EF, and DE).
Figure 2:
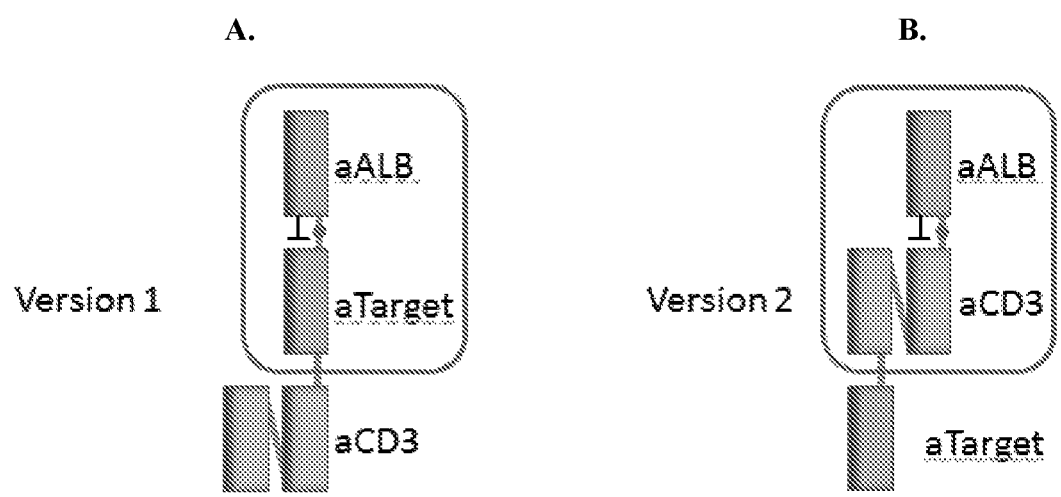
FIGS. 2A-2B provide exemplary arrangements of various domains of a conditionally active binding protein of this disclosure.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Provided herein in certain embodiments are ProTriTAC molecules (also referred to herein as protrisecific molecules) that are T cell engager prodrugs designed to be conditionally active in a tumor microenvironment. In some cases, this enables targeting of a wider selection of tumor antigens (e.g., solid tumor antigens). The ProTriTAC molecules, in some examples, combine the desirable attributes of several prodrug approaches, including, but not limited to: combination of steric and specific masking, wherein the steric masking is, in some cases, is through albumin that is recognized by an anti-albumin domain in a ProTriTAC molecule, and the specific masking, in some cases, is through specific intermolecular interactions between an anti-albumin domain (in some examples) and a target antigen binding domain of the ProTriTAC molecule (such as, an anti-CD3 scFv domain, in some examples); additional safety imparted by half-life differential of prodrug versus an active drug, derived by activation of the conditionally activated ProTriTAC molecule; ability to plug-and-play with different tumor target binders.

Certain Definitions

The terminology used herein is for the purpose of describing particular cases only and is not intended to be limiting. As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising."

The term "about" or "approximately" means within an acceptable error range for the particular value as determined by one of ordinary skill in the art, which will depend in part on how the value is measured or determined, e.g., the limitations of the measurement system. For example, "about" can mean within 1 or more than 1 standard deviation, per the practice in the given value. Where particular values are described in the application and claims, unless otherwise stated the term "about" should be assumed to mean an acceptable error range for the particular value.

The terms "individual," "patient," or "subject" are used interchangeably. None of the terms require or are limited to situation characterized by the supervision (e.g. constant or intermittent) of a health care worker (e.g. a doctor, a registered nurse, a nurse practitioner, a physician's assistant, an orderly, or a hospice worker).

A "single chain Fv" or "scFv", as used herein, refers to a binding protein in which the variable domains of the heavy chain and of the light chain of a traditional two chain antibody are joined to form one chain. Typically, a linker peptide is inserted between the two chains to allow for proper folding and creation of an active binding site.

A "cleavage site for a protease," or "protease cleavage site", as meant herein, is an amino acid sequence that can be cleaved by a protease, such as, for example, a matrix metalloproteinase or a furin. Examples of such sites include Gly-Pro-Leu-Gly-Ile-Ala-Gly-Gln (SEQ ID NO: 924) or Ala-Val-Arg-Trp-Leu-Leu-Thr-Ala (SEQ ID NO: 925), which can be cleaved by metalloproteinases, and Arg-Arg-Arg-Arg-Arg-Arg (SEQ ID NO: 926), which is cleaved by a furin. In therapeutic applications, the protease cleavage site can be cleaved by a protease that is produced by target cells, for example cancer cells or infected cells, or pathogens.

As used herein, "elimination half-time" is used in its ordinary sense, as is described in *Goodman and Gillman's The Pharmaceutical Basis of Therapeutics* 21-25 (Alfred Goodman Gilman, Louis S. Goodman, and Alfred Gilman, eds., 6th ed. 1980). Briefly, the term is meant to encompass a quantitative measure of the time course of drug elimination. The elimination of most drugs is exponential (i.e., follows first-order kinetics), since drug concentrations usually do not approach those required for saturation of the elimination process. The rate of an exponential process may be expressed by its rate constant, k, which expresses the fractional change per unit of time, or by its half-time, $t_{1/2}$ the time required for 50% completion of the process. The units of these two constants are time$^{-1}$ and time, respectively. A first-order rate constant and the half-time of the reaction are simply related ($k \times t_{1/2} = 0.693$) and may be interchanged accordingly. Since first-order elimination kinetics dictates that a constant fraction of drug is lost per unit time, a plot of the log of drug concentration versus time is linear at all times following the initial distribution phase (i.e. after drug absorption and distribution are complete). The half-time for drug elimination can be accurately determined from such a graph.

A "therapeutic agent," as used herein, includes a "binding molecule."

The term "binding molecule," as used herein is any molecule, or portion or fragment thereof, that can bind to a target molecule, cell, complex and/or tissue, and which includes proteins, nucleic acids, carbohydrates, lipids, low molecular weight compounds, and fragments thereof, each having the ability to bind to one or more of a soluble protein, a cell surface protein, a cell surface receptor protein, an intracellular protein, a carbohydrate, a nucleic acid, a hormone, or a low molecular weight compound (small molecule drug), or a fragment thereof. The binding molecule, in some instances, is a protein belonging to the immunoglobulin superfamily, or a non-immunoglobulin binding molecule. The "binding molecule" does do not include a cytokine.

The term "proteins belonging to immunoglobulin superfamily," or "immunoglobulin molecules," as used herein, include proteins that comprise an immunoglobulin fold, such as antibodies and target antigen binding fragments thereof, antigen receptors, antigen presenting molecules, receptors on natural killer cells, antigen receptor accessory molecules, receptors on leukocytes, IgSF cellular adhesion molecules, growth factor receptors, and receptor tyrosine kinases/phosphatases.

The term "antibodies" include antibodies or immunoglobulins of any isotype, fragments of antibodies that retain specific binding to antigen, including, but not limited to, Fab, Fv, scFv, and Fd fragments, chimeric antibodies, humanized antibodies, single-chain antibodies (scAb), single domain antibodies (dAb), single domain heavy chain antibodies, a single domain light chain antibodies, bi-specific antibodies, multi-specific antibodies, and fusion proteins comprising an antigen-binding (also referred to herein as antigen binding) portion of an antibody and a non-antibody protein. The antibodies, in some examples, are detectably labeled, e.g., with a radioisotope, an enzyme that generates a detectable product, a fluorescent protein, and the like. The antibodies, in some cases, are further conjugated to other moieties, such as members of specific binding pairs, e.g., biotin (member of biotin-avidin specific binding pair), and the like. The antibodies, in some cases, are bound to a solid support, including, but not limited to, polystyrene plates or beads, and the like. Also encompassed by the term are Fab', Fv, F(ab')2, and or other antigen binding fragments that retain specific binding to antigen, and monoclonal antibodies. As used herein, a monoclonal antibody is an antibody produced by a group of identical cells, all of which were produced from a single cell by repetitive cellular replication. That is, the clone of cells only produces a single antibody species. While a monoclonal antibody can be produced using hybridoma production technology, other production methods known to those skilled in the art can also be used (e.g., antibodies derived from antibody phage display libraries). An antibody, in some instances, is monovalent or bivalent. An antibody, in some instances, is an Ig monomer, which is a "Y-shaped" molecule that consists of four polypeptide chains: two heavy chains and two light chains connected by disulfide bonds.

The term "non-immunoglobulin binding molecules," as used herein, include, but is not limited to examples such as a growth factor, a hormone, a signaling protein, an inflammatory mediator, ligand, a receptor, or a fragment thereof, a native hormone or a variant thereof being able to bind to its natural receptor; a nucleic acid or polynucleotide sequence being able to bind to complementary sequence or a soluble cell surface or intracellular nucleic acid/polynucleotide binding proteins, a carbohydrate binding moiety being able to bind to other carbohydrate binding moieties, cell surface or intracellular proteins, a low molecular weight compound (drug) that binds to a soluble or cell surface or intracellular target protein. The non-immunoglobulin binding molecules, in some cases, include coagulation factors, plasma proteins, fusion proteins, and imaging agents. The non-immunoglobulin binding molecules do not include a cytokine.

A "cytokine," as meant herein, refers to intercellular signaling molecules, and active fragments and portions thereof, which are involved in the regulation of mammalian somatic cells. A number of families of cytokines, for example, interleukins, interferons, and transforming growth factors are included.

As used herein, "non-CDR loops" within immunoglobulin (Ig) molecules are regions of a polypeptide other than the complementarity determining regions (CDRs) of an antibody. These regions may be derived from an antibody or an antibody fragment. These regions may also be synthetically or artificially derived, such as through mutagenesis or polypeptide synthesis.

In an Ig, Ig-like, or beta-sandwich scaffold that has 9 beta-strands (e.g., a VH, a VL, a camelid VHH, a sdAb), the non-CDR loops can refer to the AB, CC', C"D, EF loops or loops connecting beta-strands proximal to the C-terminus. In an Ig, Ig-like, or beta-sandwich scaffold that has 7 beta-strands (e.g., a CH, a CL, an adnectin, a Fn-III), the non-CDR loops can refer to the AB, CD, and EF loops or loops connecting beta-strands proximal the C-terminus. In other Ig-like or beta-sandwich scaffolds, the non-CDR loops are the loops connecting beta-strands proximal to the C-terminus or topologically equivalent residues using the framework established in the Halaby 1999 publication (Prot Eng Des Sel 12:563-571).

In a non-beta-sandwich scaffold (e.g., a DARPin, an affimer, an affibody), the "non-CDR loops" refer to an area that is (1) amenable for sequence randomization to allow engineered specificities to a second antigen, and (2) distal to the primary specificity determining region(s) typically used on the scaffold to allow simultaneous engagement of the scaffold to both antigens without steric interference. For this purpose, the primary specificity determining region(s) can be defined using the framework established in the Skrlec 2015 publication (Trends in Biotechnol, 33:408-418). An excerpt of the framework is listed below.

| Scaffold | Primary specificity determining region(s) |
|---|---|
| Affibody | 13 residues in two helices |
| Affimer | 12-36 residues |
| Anticalin | Four loops (up to 24 aa) |
| Avimer | 11 residues |
| Scaffold | Primary specificity determining region(s) |
| Centyrin | 13 residues |
| DARPin | 7 residues in each n-repeat, or 8 residues in each n-repeat |
| Fynomer | 6 residues in the RT- and n-Src-loop |
| Kunitz domain | 1-2 loops |

"Target antigen binding domain", as used herein, refers to a region which targets a specific antigen. A target antigen binding domain comprises, for example an sdAb, an scFv, a variable heavy chain antibody (VHH), a variable heavy (VH) or a variable light domain (VL), a full length antibody, or any other peptide that has a binding affinity towards a specific antigen. The target antigen binding domain does do not include a cytokine.

"TriTAC," as used herein refers to a trispecific binding protein that is not conditionally activated.

Binding Moiety, Cleavable Linker and Conditionally Active Binding Proteins

Figure 15:
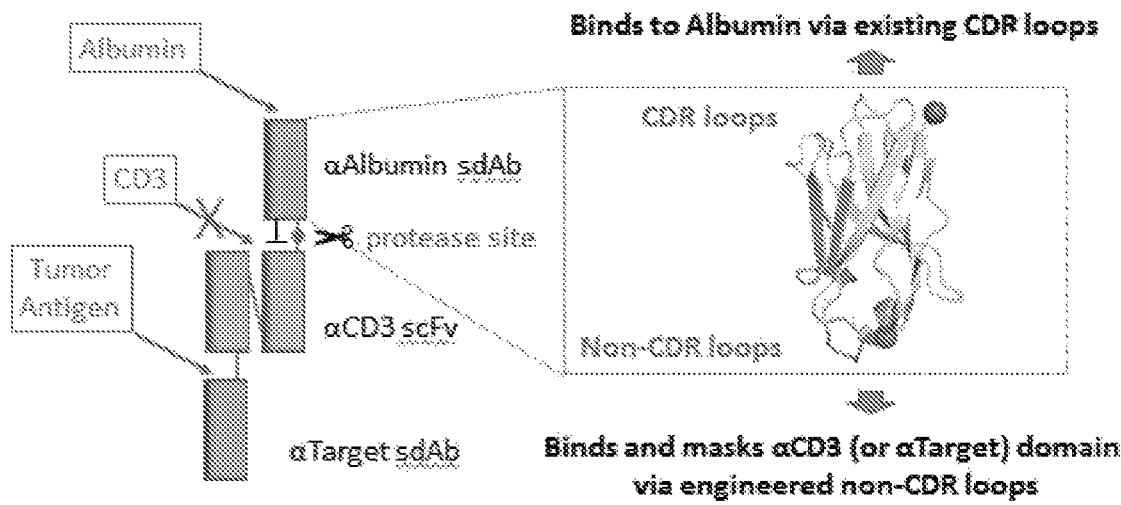
FIG. 15 shows the schematic structure of an exemplary trispecific molecule containing a binding moiety as described herein (also referred to herein as ProTriTAC or activatable ProTriTAC).
Figure 16:
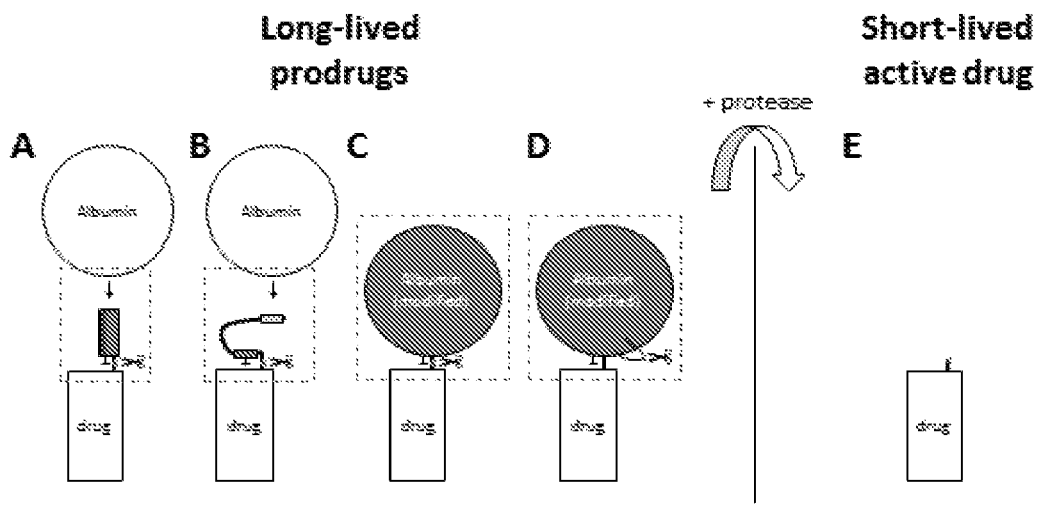
FIGS. 16A-16E shows exemplary schematic structures for Prodrug molecules combining functional masking and half-life extension.
Figure 17:
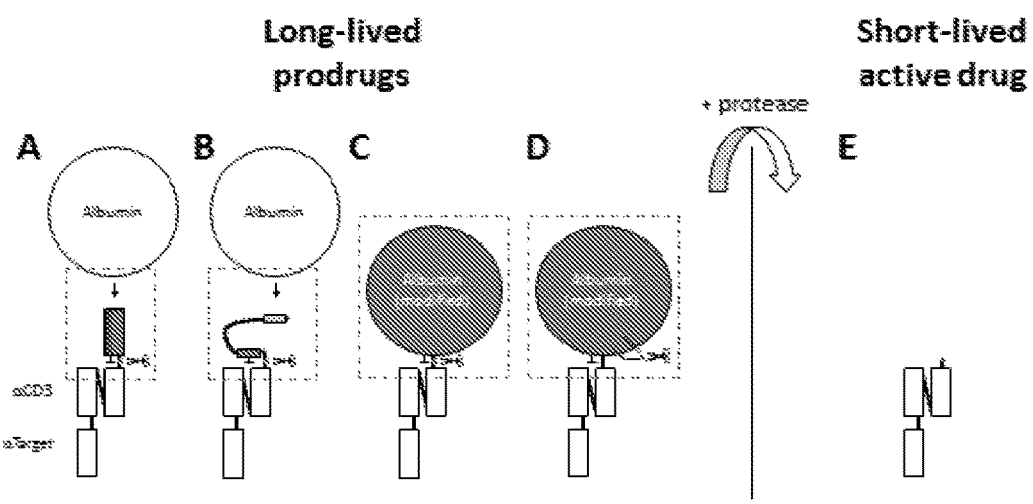
FIGS. 17A-17E show exemplary schematic structures for ProTriTAC molecules combining functional masking and half-life extension.
Figure 35:
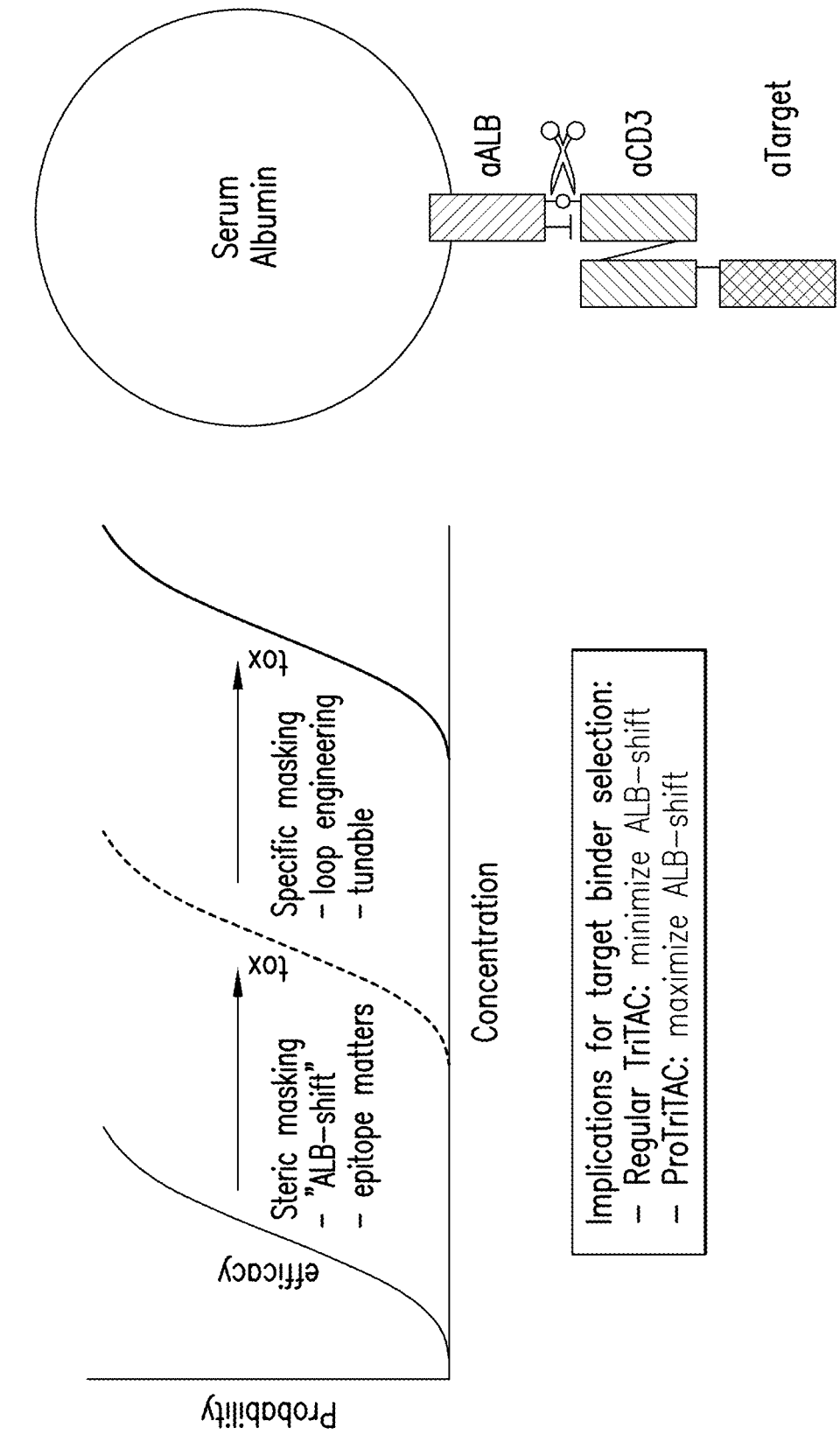
FIG. 35 illustrates that a binding moiety of this disclosure is able to expand the therapeutic window of a molecule containing it (e.g., a ProTriTAC molecule) by both steric masking and specific masking.
Figure 36:
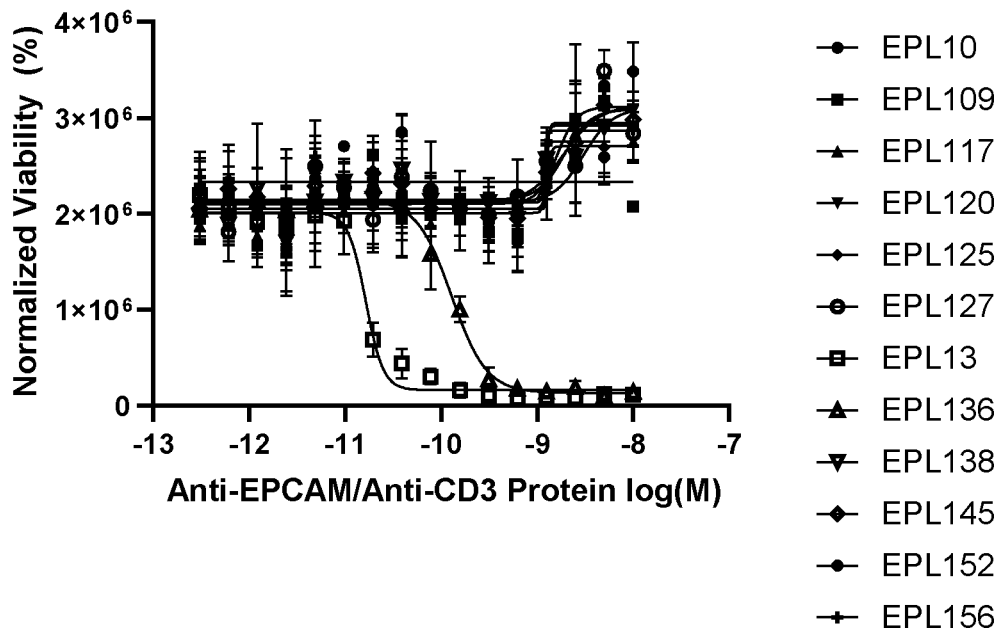
FIG. 36 provides results from a representative T cell dependency cellular cytotoxicity assay with NCI-H508 cells using exemplary fusion proteins of this disclosure containing an anti-EpCAM domain as described herein and an anti-CD3 domain.
Figure 37:
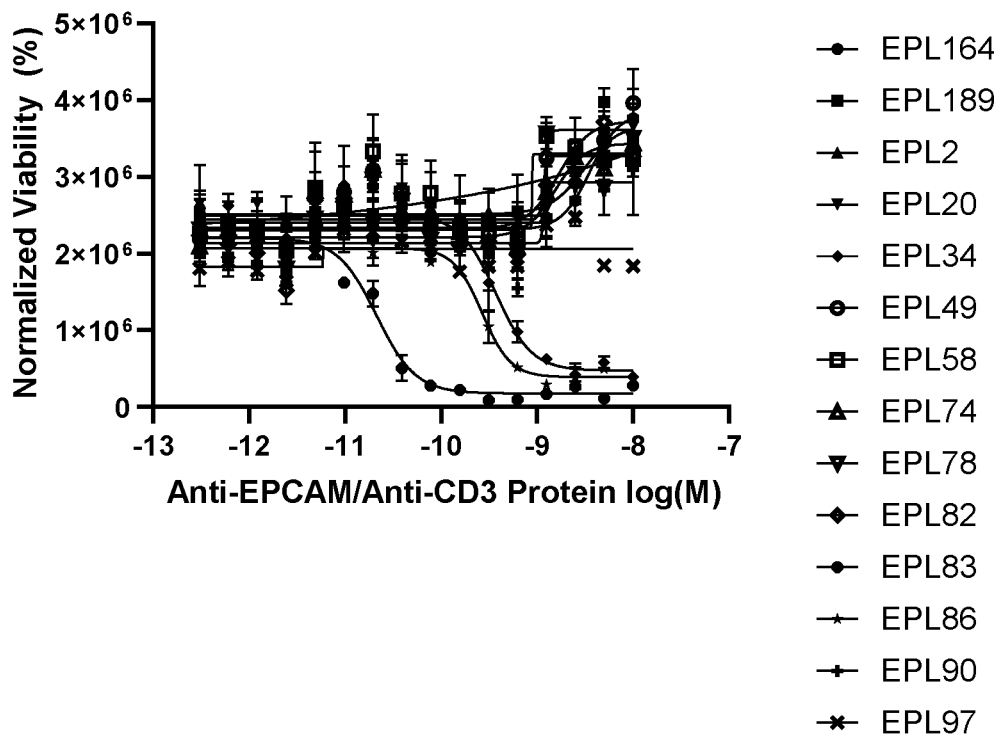
FIG. 37 provides results from a representative T cell dependency cellular cytotoxicity assay using exemplary fusion proteins of this disclosure containing an anti-EpCAM domain as described herein and an anti-CD3 domain.
Figure 38:
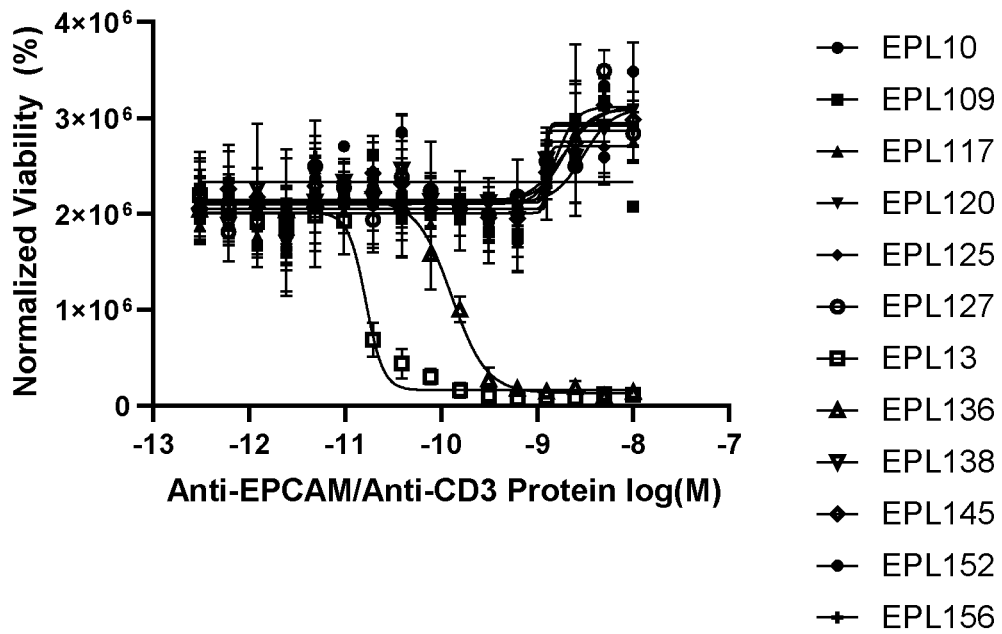
FIG. 38 provides results from a representative T cell dependency cellular cytotoxicity assay using exemplary fusion proteins of this disclosure containing an anti-EpCAM domain as described herein and an anti-CD3 domain.
Figure 39:
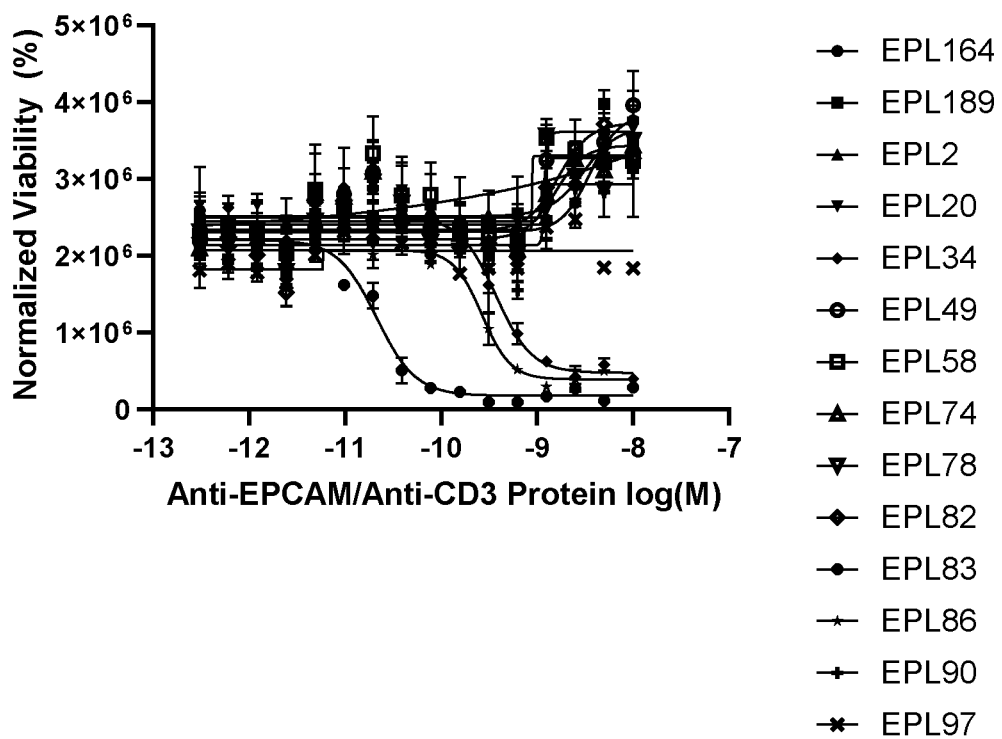
FIG. 39 provides results from a representative T cell dependency cellular cytotoxicity assay using exemplary fusion proteins of this disclosure containing an anti-EpCAM domain as described herein and an anti-CD3 domain.

This disclosure provides, in some embodiments, binding moieties that are capable of masking the interaction of binding molecules with their targets. In some embodiments, a binding moiety of this disclosure comprises a masking moiety and a cleavable linker, such as a protease cleavable linker. In some embodiments, a binding moiety of this disclosure comprises a masking moiety (e.g., a modified non-CDR loop sequence) and a non-cleavable linker. As illustrated in FIG. 35, the binding moiety is capable of synergistically expanding a therapeutic window of a molecule that comprises the moiety, by both steric masking and specific masking. In some examples, the binding molecule is a protein belonging to an immunoglobulin superfamily, such as a target antigen binding domain comprising an immunoglobulin fold. In some embodiments, the binding molecule is a non-immunoglobulin protein. In some embodiments, the binding moiety combines both steric masking (for example, via binding to a bulky serum albumin) and specific masking (for example, via non-CDR loops binding to the CDRs of an anti-CD3 scFv domain). In some cases, modifying the non-CDR loops within the binding moiety does not affect albumin binding. The protease cleavable linker, in some cases, enables activation of a prodrug molecule comprising the binding moiety (such as a ProTriTAC molecule comprising a binding moiety as described herein, a CD3 binding domain, and an albumin binding domain), in a single proteolytic event, thereby allowing more efficient conversion of the prodrug molecule in tumor microenvironment. Further, tumor-associated proteolytic activation, in some cases, reveals active T cell engager (such as a ProTriTAC molecule comprising a binding moiety as described herein, a CD3 binding domain, and an albumin binding domain) with minimal off-tumor activity after activation. The present disclosure, in some embodiments, provides a half-life extended T cell engager format (ProTriTAC) comprising a binding moiety as described herein, which in some cases represents a new and improved approach to engineer conditionally active T cell engagers.

FIG. 4B provides a schematic for an exemplary ProTriTAC molecule comprising an exemplary binding moiety as described herein (the αalbumin sdAb) and a gel showing the ProTriTAC before and after activation by cleaving of the protease cleavable linker, and FIG. 4A shows a possible mode of action of the same. FIG. 15 shows the schematic structure of an exemplary trispecific molecule containing a binding moiety as described herein (also referred to herein as ProTriTAC or activatable ProTriTAC), with engineered non-CDR loops. The exemplary trispecific molecule contains an anti-albumin domain comprising a cleavable linker (such a linker comprising a protease cleavable site, also referred to herein as a substrate linker) and a masking domain; an anti-CD3 binding domain; and an anti-target domain (specific for a tumor antigen) which in some cases is a non-immunoglobulin molecule. In some cases, non-CDR loops in the anti-albumin domain is capable of binding and masking the anti-target domain. In some cases, non-CDR loops in the anti-albumin domain is capable of binding and masking the anti-CD3 domain. The binding moiety, in some embodiments, comprises a CDR loop specific for binding albumin.

Provided herein, in a first embodiment, is a binding moiety that masks the binding of a target antigen binding domain, and is capable of binding to a bulk-serum protein, such as a half-life extending protein. The binding moiety of the first embodiment, in certain instances, further comprises a cleavable linker attached to it. The cleavable linker, for example, comprises a protease cleavage site or a pH dependent cleavage site. The cleavable linker, in certain instances, is cleaved only in a tumor micro-environment. Thus, in some examples, the binding moiety of the first embodiment, bound to the half-life extending protein, connected to the cleavable linker, and further bound to the target antigen binding domain, maintains the target antigen binding domain in an inert state in circulation until the cleavable linker is cleaved off in a tumor microenvironment. The half-life of the target antigen binding domain, such as an antibody or an antigen binding fragment thereof, is thus extended in systemic circulation by using the binding moiety of the first embodiment which acts as a safety switch that keeps the target antigen binding moiety in an inert state until it reaches the tumor microenvironment where it is conditionally activated by cleavage of the linker and is able to bind its target antigen.

In a second embodiment is provided a binding moiety that masks the interaction between a non-immunoglobulin binding molecule and its target. The binding moiety of the second embodiment, in certain instances, is capable of binding to a bulk serum protein. In some instances, the binding moiety of the second embodiment further comprises a cleavable linker attached to it. The cleavable linker, for example, comprises a protease cleavage site or a pH dependent cleavage site. The cleavable linker, in certain instances, is cleaved only in a tumor micro-environment. The non-immunoglobulin binding molecule is, in some cases, maintained in an inert state by the binding moiety of the second embodiment and activated by cleavage of the linker, for example in a target environment. In some instances, the cleavable linker is cleaved off in a tumor microenvironment and in such cases the tumor microenvironment is the target environment. The half-life of the non-immunoglobulin binding molecule is thus extended in systemic circulation by using the binding moiety of the second embodiment which acts as a safety switch that keeps the non-immunoglobulin binding molecule in an inert state until it reaches the target environment where it is conditionally activated by cleavage of the linker. In some examples of the second embodiment where the non-immunoglobulin binding molecule is an imaging agent, said agent is activated in a target environment upon cleavage of the cleavable linker. The target environment, in such cases, is a tissue or a cell or any biological environment that is to be imaged using the imaging agent.

The safety switch described above provides several advantages; some examples including (i) expanding the therapeutic window of the immunoglobulin molecule, such as a target antigen binding domain, a non-immunoglobulin binding molecule; (ii) reducing target-mediated drug disposition by maintaining the immunoglobulin molecule, such as a target antigen binding domain, the non-immunoglobulin binding molecule, in an inert state when a conditionally active protein comprising a binding moiety according to the first or second embodiments is in systemic circulation; (iii) reducing the concentration of undesirable activated proteins in systemic circulation, thereby minimizing the spread of chemistry, manufacturing, and controls related impurities, e.g., pre-activated drug product, endogenous viruses, host-cell proteins, DNA, leachables, anti-foam, antibiotics, toxins, solvents, heavy metals; (iv) reducing the concentration of undesirable activated proteins in systemic circulation, thereby minimizing the spread of product related impurities, aggregates, breakdown products, product variants due to: oxidation, deamidation, denaturation, loss of C-term Lys in MAbs; (v) preventing aberrant activation of the immunoglobulin molecule, such as a target antigen binding domain, or the non-immunoglobulin binding molecule in circulation; (vi) reducing the toxicities associated with the leakage of activated species from diseased tissue or other pathophysiological conditions, e.g., tumors, autoimmune diseases, inflammations, viral infections, tissue remodeling events (such as myocardial infarction, skin wound healing), or external injury (such as X-ray, CT scan, UV exposure); and (vii) reducing non-specific binding of the immunoglobulin molecule, such as a target antigen binding domain, or the non-immunoglobulin binding molecule. Furthermore, post-activation, or in other words post breaking of the safety switch, the immunoglobulin molecule, such as a target antigen binding domain, the non-immunoglobulin binding molecule is separated from the safety switch which provided extended half-life, and thus is cleared from circulation.

In addition, the binding moieties of the first, second, and the third embodiments, in some cases, are used to generate a "biobetter" version of a biologic. Generally, preparing a biobetter form of a molecule, e.g., an antibody or an antigen binding fragment thereof, involves taking the originator molecule and making specific alterations in it to improve its parameters and thereby make it a more efficacious, less frequently dosed, better targeted, and/or a better tolerated drug. Thus, a target antigen binding domain masked by the binding moiety of the first embodiment which is bound to a half-life extending protein, and conditionally activated in a tumor microenvironment by cleavage of the cleavable linker, gives the target antigen binding domain a significantly longer serum half-life and reduces the likelihood of its undesirable activation in circulation, thereby producing a "biobetter" version of the target antigen binding domain. Similarly, the binding moieties of the second embodiment are, in some cases, utilized to generate biobetter versions of the non-immunoglobulin binding molecules. Accordingly, in various embodiments, biobetter versions of immunoglobulin molecules, non-immunoglobulin binding molecules are provided, wherein the biobetter function is attributed to a binding moiety, respectively, according to the first or second embodiments.

The binding moieties described herein comprise at least one non-CDR loop. In some embodiments, a non-CDR loop provides a binding site for binding of the binding moiety of the first embodiment to a target antigen binding domain. In some examples of the first embodiment, a non-CDR loop provides a binding site for binding of the binding moiety of the first embodiment to an immunoglobulin molecules, such as a target antigen binding domain. In some examples of the second embodiment, a non-CDR loop provides a binding site for binding of the binding moiety of the second embodiment to a non-immunoglobulin binding molecule. In some cases, the binding moiety of the first embodiment masks binding of the target binding domain to the target antigen, e.g. via steric occlusion, via specific intermolecular interactions, or a combination of both. The binding moieties of the second embodiment also, in some cases, mask binding of a non-immunoglobulin binding molecule to their targets, via steric occlusion, via specific intermolecular interactions, or a combination of both.

In some embodiments, the binding moieties described herein further comprise complementarity determining regions (CDRs). In some instances, the binding moieties are domains derived from an immunoglobulin molecule (Ig molecule). The Ig may be of any class or subclass (IgG1, IgG2, IgG3, IgG4, IgA, IgE, IgM etc). A polypeptide chain of an Ig molecule folds into a series of parallel beta strands linked by loops. In the variable region, three of the loops constitute the "complementarity determining regions" (CDRs) which determine the antigen binding specificity of the molecule. An IgG molecule comprises at least two heavy (H) chains and two light (L) chains inter-connected by disulfide bonds, or an antigen binding fragment thereof. Each heavy chain is comprised of a heavy chain variable region (abbreviated herein as VH) and a heavy chain constant region. The heavy chain constant region is comprised of three domains, CH1, CH2 and CH3. Each light chain is comprised of a light chain variable region (abbreviated herein as VL) and a light chain constant region. The light chain constant region is comprised of one domain, CL. The VH and VL regions can be further subdivided into regions of hypervariability, termed complementarity determining regions (CDRs) with are hypervariable in sequence and/or involved in antigen recognition and/or usually form structurally defined loops, interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. In some embodiments of this disclosure, at least some or all of the amino acid sequences of FR1, FR2, FR3, and FR4 are part of the "non-CDR loop" of the binding moieties described herein. As shown in FIG. 1, a variable domain of an immunoglobulin molecule has several beta strands that are arranged in two sheets. The variable domains of both light and heavy immunoglobulin chains contain three hypervariable loops, or complementarity-determining regions (CDRs). The three CDRs of a V domain (CDR1, CDR2, CDR3) cluster at one end of the beta barrel. The CDRs are the loops that connect beta strands B-C, C'-C", and F-G of the immunoglobulin fold, whereas the bottom loops that connect beta strands AB, CC', C"-D and E-F of the immunoglobulin fold, and the top loop that connects the D-E strands of the immunoglobulin fold are the non-CDR loops. In some embodiments of this disclosure, at least some amino acid residues of a constant domain, CH1, CH2, or CH3, are part of the "non-CDR loop" of the binding moieties described herein. Non-CDR loops comprise, in some embodiments, one or more of AB, CD, EF, and DE loops of a C1-set domain of an Ig or an Ig-like molecule; AB, CC', EF, FG, BC, and EC' loops of a C2-set domain of an Ig or an Ig-like molecule; DE, BD, GF, A(A1A2)B, and EF loops of I(Intermediate)-set domain of an Ig or Ig-like molecule.

Within the variable domain, the CDRs are believed to be responsible for antigen recognition and binding, while the FR residues are considered a scaffold for the CDRs. However, in certain cases, some of the FR residues play an important role in antigen recognition and binding. Framework region residues that affect Ag binding are divided into two categories. The first are FR residues that contact the antigen, thus are part of the binding-site, and some of these residues are close in sequence to the CDRs. Other residues are those that are far from the CDRs in sequence, but are in close proximity to it in the 3-D structure of the molecule, e.g., a loop in heavy chain.

In some embodiments, the non-CDR loop is modified to generate an antigen binding site specific for a bulk serum protein, such as albumin. It is contemplated that various techniques can be used for modifying the non-CDR loop, e.g., site-directed mutagenesis, random mutagenesis, insertion of at least one amino acid that is foreign to the non-CDR loop amino acid sequence, amino acid substitution. An antigen peptide is inserted into a non-CDR loop, in some examples. In some examples, an antigenic peptide is substituted for the non-CDR loop. The modification, to generate an antigen binding site, is in some cases in only one non-CDR loop. In other instances, more than one non-CDR loop are modified. For instance, the modification is in any one of the non-CDR loops shown in FIG. 1, i.e., AB, CC', C" D, EF, and D-E. In some cases, the modification is in the DE loop. In other cases the modifications are in all four of AB, CC', C"-D, E-F loops. In certain examples, the binding moieties described herein are bound to the immunoglobulin molecules, e.g., a target antigen binding domain, the non-immunoglobulin binding molecules via their AB, CC', C" D, or EF loop and are bound to a bulk-serum protein, such as albumin, via their B-C, C'-C", or F-G loop. In certain examples, the binding moiety of the first embodiment is bound to the target antigen binding domain via its AB, CC', C" D, and EF loop and is bound to a bulk-serum protein, such as albumin, via its BC, C'C", and FG loop.

In certain examples, the binding moiety of the first embodiment is bound to a target antigen binding domain via one or more of AB, CC', C" D, and E-F loop and is bound to a bulk-serum protein, such as albumin, via one or more of BC, C'C", and FG loop. In certain examples, the binding moiety of the first embodiment is bound to a bulk serum protein, such as albumin, via its AB, CC', C" D, or EF loop and is bound to a target antigen binding domain via its BC, C'C", or FG loop. In certain examples, the binding moiety of the first embodiment is bound to a bulk serum protein, such as albumin, via its AB, CC', C" D, and EF loop and is bound to a target antigen binding domain via its BC, C'C", and FG loop. In certain examples, the binding moiety of the first embodiment is bound to a bulk serum protein, such as albumin, via one or more of AB, CC', C" D, and E-F loop and is bound to the target antigen binding protein, via one or more of BC, C'C", and FG loop.

In certain examples, the binding moiety of the second embodiment is bound to a non-immunoglobulin molecule via one or more of AB, CC', C" D, and E-F loop and is bound to a bulk-serum protein, such as albumin, via one or more of BC, C'C", and FG loop. In certain examples, the binding moiety of the second embodiment is bound to a bulk serum protein, such as albumin, via its AB, CC', C" D, or EF loop and is bound to a non-immunoglobulin molecule via its BC, C'C", or FG loop. In certain examples, the binding moiety of the second embodiment is bound to a bulk serum protein, such as albumin, via its AB, CC', C" D, and EF loop and is bound to a non-immunoglobulin molecule via its BC, C'C", and FG loop. In certain examples, the binding moiety of the second embodiment is bound to a bulk serum protein, such as albumin, via one or more of AB, CC', C" D, and E-F loop and is bound to a non-immunoglobulin molecule, via one or more of BC, C'C", and FG loop.

The binding moieties are any kinds of polypeptides. For example, in certain instances the binding moieties are natural peptides, synthetic peptides, or fibronectin scaffolds, or engineered bulk serum proteins. The bulk serum protein comprises, for example, albumin, fibrinogen, or a globulin. In some embodiments, the binding moieties are engineered scaffolds. Engineered scaffolds comprise, for example, sdAb, a scFv, a Fab, a VHH, a fibronectin type III domain, immunoglobulin-like scaffold (as suggested in Halaby et al., 1999. Prot Eng 12(7):563-571), DARPin, cystine knot peptide, lipocalin, three-helix bundle scaffold, protein G-related albumin-binding module, or a DNA or RNA aptamer scaffold.

In some cases, the binding moiety of the first embodiment binds to at least one target antigen binding domain. In further embodiments, the non-CDR loops within the binding moiety of the first embodiment provide a binding site for the at least one target antigen binding domain. The target antigen binding domain, in some cases, binds to target antigens expressed on the surface of a diseased cell or tissue, for example a tumor or a cancer cell. Target antigens include but are not limited to EpCAM, EGFR, HER-2, HER-3, c-Met, FoIR, PSMA, CD38, BCMA, and CEA. 5T4, AFP, B7-H3, CDH-6, CAIX, CD117, CD123, CD138, CD166, CD19, CD20, CD205, CD22, CD30, CD33, CD352, CD37, CD44, CD52, CD56, CD70, CD71, CD74, CD79b, DLL3, EphA2, FAP, FGFR2, FGFR3, GPC3, gpA33, FLT-3, gpNMB, HPV-16 E6, HPV-16 E7, ITGA2, ITGA3, SLC39A6, MAGE, mesothelin, Muc1, Muc16, NaPi2b, Nectin-4, CDH-3, CDH-17, EPHB2, ITGAV, ITGB6, NY-ESO-1, PRLR, PSCA, PTK7, ROR1, SLC44A4, SLITRK5, SLITRK6, STEAP1, TIM1, Trop2, or WT1.

Figure 3:
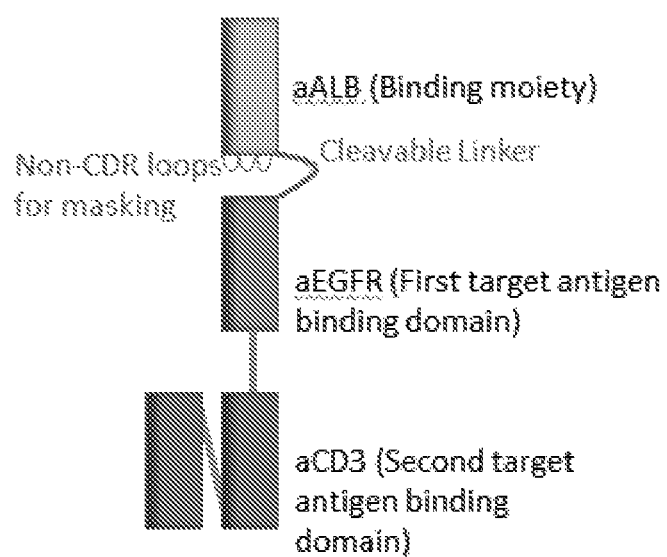
FIG. 3 shows an exemplary conditionally active target binding protein of this disclosure.

In some cases, the binding moiety of the first embodiment is bound to a first target antigen binding domain via its non-CDR loops and the first target antigen binding domain is further connected to a second target antigen binding domain. Examples of first and second target antigen binding domains include, but are not limited to, a T cell engager, a bispecific T cell engager, a dual-affinity re-targeting antibody, a variable heavy domain (VH), a variable light domain (VL), a scFv comprising a VH and a VL domain, a soluble TCR fragment comprising a Valpha and Vbeta domain, a single domain antibody (sdAb), or a variable domain of camelid derived nanobody (VHH), a non-Ig binding domain, i.e., antibody mimetic, such as anticalins, affilins, affibody molecules, affimers, affitins, alphabodies, avimers, DARPins, fynomers, kunitz domain peptides, and monobodies, a ligand or peptide. In some examples, the first or the second target antigen binding domain is a VHH domain. In some examples, the first or the second target antigen binding domain is a sdAb. In some instances, the first target antigen binding domain is specific for a tumor antigen, such as EGFR, and the second target antigen binding domain is specific for CD3. The binding of the first target antigen binding domain to its target, e.g., a tumor antigen such as EGFR, is masked by the binding moiety of the first embodiment, via its non-CDR loops. One exemplary conditionally active protein, comprising a binding moiety according to the first embodiment, is shown in FIG. 3.

In some cases, the non-CDR loops within the binding moiety of the second embodiment provide a binding site for a non-immunoglobulin binding molecule.

In some cases, the binding moieties comprise a binding site for a bulk serum protein. In some embodiments, the CDRs within the binding moieties provide a binding site for the bulk serum protein. The bulk serum protein is, in some examples, a globulin, albumin, transferrin, IgG1, IgG2, IgG4, IgG3, IgA monomer, Factor XIII, Fibrinogen, IgE, or pentameric IgM. In some embodiments, the binding moieties comprise a binding site for an immunoglobulin light chain. In some embodiments, the CDRs provide a binding site for the immunoglobulin light chain. The immunoglobulin light chain is, in some examples, an IgK free light chain or an Ig, free light chain.

In some examples, the binding moieties comprise any type of binding domain, including but not limited to, domains from a monoclonal antibody, a polyclonal antibody, a recombinant antibody, a human antibody, a humanized antibody. In some embodiments, the binding moiety is a single chain variable fragment (scFv), a soluble TCR fragment, a single-domain antibody such as a heavy chain variable domain (VH), a light chain variable domain (VL) and a variable domain (VHH) of camelid derived nanobody. In other embodiments, the binding moieties are non-Ig binding domains, i.e., antibody mimetic, such as anticalins, affilins, affibody molecules, affimers, affitins, alphabodies, avimers, DARPins, fynomers, kunitz domain peptides, and monobodies.

TABLE 1

Exemplary Sequences for Masking Sequences within the Binding Moieties of this Disclosure are Provided In SEQ ID Nos. 50, 259-301 And 795.

| MaskID | Sequence | Alt. Names | SEQ ID No. |
|---|---|---|---|
| MASK001 | APGKG | WT | SEQ ID No. 795 |
| MASK002 | GGQDGNEEMGGG | CC12 | SEQ ID No. 259 |
| MASK004 | GGQDGNEEGG | CC10 | SEQ ID No. 260 |
| MASK006 | GGGGQDGNEEMGGGGG | CC16 | SEQ ID No. 261 |
| MASK007 | APFGSEM | | SEQ ID No. 262 |
| MASK008 | AWNGPYE | | SEQ ID No. 263 |
| MASK009 | AQDNGDTKTG | | SEQ ID No. 264 |
| MASK010 | AEAKETQG | | SEQ ID No. 265 |
| MASK011 | ATRREQVEG | | SEQ ID No. 266 |
| MASK012 | AQAPSQP | | SEQ ID No. 267 |
| MASK013 | ATRSRTRNDG | | SEQ ID No. 268 |
| MASK014 | ADVDAPDGLG | | SEQ ID No. 269 |
| MASK015 | AADISDPGG | | SEQ ID No. 270 |
| MASK016 | ALSVDPSG | | SEQ ID No. 271 |
| MASK017 | ARLSVDPG | | SEQ ID No. 272 |

TABLE 1-continued

Exemplary Sequences for Masking Sequences within the Binding Moieties of this Disclosure are Provided In SEQ ID Nos. 50, 259-301 And 795.

| MaskID | Sequence | Alt. Names | SEQ ID No. |
|---|---|---|---|
| MASK018 | AVEAADRG | | SEQ ID No. 273 |
| MASK020 | GGPDGNEEMGGG | CC12-Q1P | SEQ ID No. 274 |
| MASK021 | GGFDGNEEMGGG | CC12-Q1F | SEQ ID No. 275 |
| MASK022 | GGGDGNEEMGGG | CC12-Q1G | SEQ ID No. 276 |
| MASK023 | GGEMDGEGQNGG | CC12-scramble | SEQ ID No. 277 |
| MASK024 | GGGGGPDGNEEPGG | | SEQ ID No. 278 |
| MASK025 | GGGGSLDGNEEPGG | | SEQ ID No. 279 |
| MASK026 | GGGGALDGNEEPGG | | SEQ ID No. 280 |
| MASK027 | GGGGGLDGNEEPGG | | SEQ ID No. 281 |
| MASK028 | GGGALDGNEEPGG | | SEQ ID No. 282 |
| MASK029 | GGGGGPDGNEEPGGG | | SEQ ID No. 283 |
| MASK030 | GGSGALDGNEEPGG | | SEQ ID No. 284 |
| MASK031 | GGSGSLDGNEEPGG | | SEQ ID No. 285 |
| MASK038 | GGSGGPDGNEEPGG | | SEQ ID No. 286 |
| MASK039 | GGVRDGPDGNEEPGG | | SEQ ID No. 287 |
| MASK040 | GGSGGPDGNEEPGGGG | | SEQ ID No. 288 |
| MASK041 | GGGRGPDGNEEPGG | | SEQ ID No. 289 |
| MASK042 | GGSGGLDGNEEPGG | | SEQ ID No. 290 |
| MASK043 | GGGVGPDGNEEPGG | | SEQ ID No. 291 |
| MASK044 | GGGEGPDGNEEPGG | | SEQ ID No. 292 |
| MASK046 | GGGVALDGNEEPGG | | SEQ ID No. 293 |
| MASK047 | GGGRALDGNEEPGG | | SEQ ID No. 294 |
| MASK048 | GGYAGLDGNEEPGG | | SEQ ID No. 295 |
| MASK049 | GGAGGPDGNEEPGG | | SEQ ID No. 296 |
| MASK051 | GGRGGPDGNEEPGG | | SEQ ID No. 297 |
| MASK052 | GGGGPDGNEEPGGGG | | SEQ ID No. 298 |
| MASK053 | GGGEALDGNEEPGG | | SEQ ID No. 299 |
| MASK054 | GGDASLDGNEEPGG | | SEQ ID No. 300 |
| MASK055 | GGRDAPDGNEEGG | | SEQ ID No. 301 |

It is contemplated herein that in some embodiments of this disclosure the binding moieties described herein comprise at least one cleavable linker. In one aspect, the cleavable linker comprises a polypeptide having a sequence recognized and cleaved in a sequence-specific manner. The cleavage, in certain examples, is enzymatic, based on pH sensitivity of the cleavable linker, or by chemical degradation. The conditionally active binding proteins contemplated herein, in some cases, comprise a protease cleavable linker recognized in a sequence-specific manner by a matrix metalloprotease (MMP), for example a MMP9. In some cases, the protease cleavable linker is recognized by a MMP9 comprises a polypeptide having an amino acid sequence PR(S/T)(L/I)(S/T) (SEQ ID NO: 3). In some cases, the protease cleavable linker recognized by a MMP9 comprises a polypeptide having an amino acid sequence LEATA (SEQ ID NO: 4). In some cases, the protease cleavable linker is recognized in a sequence-specific manner by a MMP11. In some cases, the protease cleavable linker recognized by a MMP11 comprises a polypeptide having an amino acid sequence GGAANLVRGG (SEQ ID NO: 5). In some cases, the protease cleavable linker is recognized by a protease disclosed in Table 3. In some cases, the protease cleavable linker is recognized by a protease disclosed in Table 3 comprises a polypeptide having an amino acid sequence selected from a sequence disclosed in Table 3 (SEQ ID NOS: 1-42, 53, and 58-62). In some cases, the cleavable linker has an amino acid sequence as set forth in SEQ ID No. 59. In some cases, the cleavable linker is recognized by MMP9, matriptase, Urokinase plasminogen activator (uPA) and has an amino acid sequence as set forth in SEQ ID No. 59.

In some embodiments of this disclosure the binding moieties described herein comprise at least one non-cleavable linker. The non-cleavable linker comprises, in some examples, a sequence as set forth in SEQ ID No. 51, SEQ ID No. 302, SEQ ID No. 303, SEQ ID No. 304, or SEQ ID No. 305.

TABLE 2

Exemplary Non-cleavable Linker Sequences

| Non-cleavable Linker ID | Sequence | SEQ ID No. |
|---|---|---|
| L002 | SGGGGSGGVV | SEQ ID No. 302 |
| L016 | SGGGGSGGGGSGGGGS | SEQ ID No. 303 |
| L017 | SGGGGSGGGGSGGGGGS | SEQ ID No. 304 |
| L046 | SGGGGSGGGS | SEQ ID No. 305 |

Proteases are proteins that cleave proteins, in some cases, in a sequence-specific manner. Proteases include but are not limited to serine proteases, cysteine proteases, aspartate proteases, threonine proteases, glutamic acid proteases, metalloproteases, asparagine peptide lyases, serum proteases, cathepsins, Cathepsin B, Cathepsin C, Cathepsin D, Cathepsin E, Cathepsin K, Cathepsin L, kallikreins, hK1, hK10, hK15, plasmin, collagenase, Type IV collagenase, stromelysin, Factor Xa, chymotrypsin-like protease, trypsin-like protease, elastase-like protease, subtilisin-like protease, actinidain, bromelain, calpain, caspases, caspase-3, Mir1-CP, papain, HIV-1 protease, HSV protease, CMV protease, chymosin, renin, pepsin, matriptase, legumain, plasmepsin, nepenthesin, metalloexopeptidases, metal loendopeptidases, matrix metalloproteases (MMP), MMP1, MMP2, MMP3, MMP7, MMP8, MMP9, MMP13, MMP11, MMP14, urokinase plasminogen activator (uPA), enterokinase, prostate-specific antigen (PSA, hK3), interleukin-1β converting enzyme, thrombin, FAP (FAP-α), dipeptidyl peptidase, type II transmembrane serine proteases (TTSP), neutrophil serine protease, cathepsin G, proteinase 3, neutrophil serine protease 4, mast cell chymase, and mast cell tryptases.

TABLE 3

Exemplary Proteases and Protease Recognition Sequences

| Protease | Cleavage Domain Sequence | SEQ ID NO: |
|---|---|---|
| MMP7 | KRALGLPG | 1 |
| MMP7 | (DE)₈RPLALWRS(DR)₈ | 2 |
| MMP9 | PR(S/T)(L/I)(S/T) | 3 |
| MMP9 | LEATA | 4 |
| MMP11 | GGAANLVRGG | 5 |
| MMP14 | SGRIGFLRTA | 6 |
| MMP | PLGLAG | 7 |
| MMP | PLGLAX | 8 |
| MMP | PLGC(me)AG | 9 |
| MMP | ESPAYYTA | 10 |
| MMP | RLQLKL | 11 |
| MMP | RLQLKAC | 12 |
| MMP2, MMP9, MMP14 | EP(Cit)G(Hof)YL | 13 |
| Urokinase plasminogen activator (uPA) | SGRSA | 14 |
| Urokinase plasminogen activator (uPA) | DAFK | 15 |
| Urokinase plasminogen activator (uPA) | GGGRR | 16 |
| Lysosomal Enzyme | GFLG | 17 |
| Lysosomal Enzyme | ALAL | 18 |
| Lysosomal Enzyme | FK | 19 |
| Cathepsin B | NLL | 20 |
| Cathepsin D | PIC(Et)FF | 21 |
| Cathepsin K | GGPRGLPG | 22 |
| Prostate Specific Antigen | HSSKLQ | 23 |
| Prostate Specific Antigen | HSSKLQL | 24 |
| Prostate Specific Antigen | HSSKLQEDA | 25 |
| Herpes Simplex Virus Protease | LVLASSSFGY | 26 |
| HIV Protease | GVSQNYPIVG | 27 |
| CMV Protease | GVVQASCRLA | 28 |
| Thrombin | F(Pip)RS | 29 |
| Thrombin | DPRSFL | 30 |
| Thrombin | PPRSFL | 31 |
| Caspase-3 | DEVD | 32 |
| Caspase-3 | DEVDP | 33 |
| Caspase-3 | KGSGDVEG | 34 |
| Interleukin 1β converting enzyme | GWEHDG | 35 |
| Enterokinase | EDDDDKA | 36 |
| FAP | KQEQNPGST | 37 |
| Kallikrein 2 | GKAFRR | 38 |
| Plasmin | DAFK | 39 |
| Plasmin | DVLK | 40 |
| Plasmin | DAFK | 41 |
| TOP | ALLLALL | 42 |
| MMP9 + matriptase | KPLGLQARVV | 58 |
| MMP9 + matriptase + uPA | PQASTGRSGG | 59 |
| MMP9 + matriptase + uPA | PQGSTGRAAG | 60 |
| Matriptase + uPA | PPASSGRAGG | 61 |
| MMP9 + matriptase | PIPVQGRAH | 62 |
| MMP9 + matriptase | PQGSTARSAG | 909 |

Proteases are known to be secreted by some diseased cells and tissues, for example tumor or cancer cells, creating a microenvironment that is rich in proteases or a protease-rich microenvironment. In some case, the blood of a subject is rich in proteases. In some cases, cells surrounding the tumor secrete proteases into the tumor microenvironment. Cells surrounding the tumor secreting proteases include but are not limited to the tumor stromal cells, myofibroblasts, blood cells, mast cells, B cells, NK cells, regulatory T cells, macrophages, cytotoxic T lymphocytes, dendritic cells, mesenchymal stem cells, polymorphonuclear cells, and other cells. In some cases, proteases are present in the blood of a subject, for example proteases that target amino acid sequences found in microbial peptides. This feature allows for targeted therapeutics such as antigen binding proteins to have additional specificity because T cells will not be bound by the antigen binding protein except in the protease rich microenvironment of the targeted cells or tissue.

The binding moiety comprising the cleavable linker thus masks the binding of a first or a second target antigen binding domain to their respective targets. In some embodiments, the binding moiety is bound to a first target antigen binding domain, which is further bound to a second target antigen binding domain, in the following order: binding moiety (M): cleavable linker (L): first target antigen binding domain (T1): second antigen binding domain (T2). In other examples, the domains are organized in any one of the following orders: M:L:T2:T1; T2:T1:L:M, T1:T2:L:M. The binding moiety is further bound to a half-life extending protein, such as albumin or any other of its targets as described below. In some instances, the binding moiety is albumin or comprises a binding site for albumin. In some instances the binding moiety comprises a binding site for IgE. In some embodiments, the binding moiety comprises a binding site for Igκ free light chain.

TABLE 4

Exemplary sequences for the binding moieties comprising a cleavable linker are provided in SEQ ID Nos. 796-800.

Sequence

SEQ ID No. 796
EVOLVESGGGLVQPGNSLRLSCAASGFTFSKFGMSWVRQGGGGGLDGNE
EPGGLEWVSSISGSGRDTLYADSVKGRFTISRDNAKTTLYLQMNSLRPE
DTAVYYCTIGGSLSVSSQGTLVTVSSGGGGKPLGLQARVVGGGGT

SEQ ID No. 797
EVOLVESGGGLVQPGNSLRLSCAASGFTFSKFGMSWVRQGGGGGLDGNE
EPGGLEWVSSISGSGRDTLYADSVKGRFTISRDNAKTTLYLQMNSLRPE
DTAVYYCTIGGSLSVSSQGTLVTVSSGGGGPQASTGRSGGGGGGT

SEQ ID No. 798
EVOLVESGGGLVQPGNSLRLSCAASGFTFSKFGMSWVRQGGGGGLDGNE
EPGGLEWVSSISGSGRDTLYADSVKGRFTISRDNAKTTLYLQMNSLRPE
DTAVYYCTIGGSLSVSSQGTLVTVSSGGGGPQGSTGRAAGGGGGT

SEQ ID No. 799
EVOLVESGGGLVQPGNSLRLSCAASGFTFSKFGMSWVRQGGGGGLDGNE
EPGGLEWVSSISGSGRDTLYADSVKGRFTISRDNAKTTLYLQMNSLRPE
DTAVYYCTIGGSLSVSSQGTLVTVSSGGGGPPASSGRAGGGGGT

SEQ ID No. 800
EVOLVESGGGLVQPGNSLRLSCAASGFTFSKFGMSWVRQGGGGGLDGNE
EPGGLEWVSSISGSGRDTLYADSVKGRFTISRDNAKTTLYLQMNSLRPE
DTAVYYCTIGGSLSVSSQGTLVTVSSGGGGPIPVQGRAHGGGGT

Targets of Conditionally Active Binding Proteins

The conditionally active binding proteins described herein are activated by cleavage of the at least one cleavable linker attached to the binding moieties within said conditionally active proteins. It is contemplated that in some cases the activated binding protein binds to a target antigen involved in and/or associated with a disease, disorder or condition. In particular, target antigens associated with a proliferative disease, a tumorous disease, an inflammatory disease, an immunological disorder, an autoimmune disease, an infectious disease, a viral disease, an allergic reaction, a parasitic reaction, a graft-versus-host disease or a host-versus-graft disease are contemplated to be the target for the activated binding proteins disclosed herein.

In some embodiments, the target antigen is a tumor antigen expressed on a tumor cell. Tumor antigens are well known in the art and include, for example, EpCAM, EGFR, HER-2, HER-3, c-Met, FoIR, PSMA, CD38, BCMA, and CEA. 5T4, AFP, B7-H3, CDH-6, CAIX, CD117, CD123, CD138, CD166, CD19, CD20, CD205, CD22, CD30, CD33, CD352, CD37, CD44, CD52, CD56, CD70, CD71, CD74, CD79b, DLL3, EphA2, FAP, FGFR2, FGFR3, GPC3, gpA33, FLT-3, gpNMB, HPV-16 E6, HPV-16 E7, ITGA2, ITGA3, SLC39A6, MAGE, mesothelin, Muc1, Muc16, NaPi2b, Nectin-4, CDH-3, CDH-17, EPHB2, ITGAV, ITGB6, NY-ESO-1, PRLR, PSCA, PTK7, ROR1, SLC44A4, SLITRK5, SLITRK6, STEAP1, TIM1, Trop2, or WT1.

In some embodiments, the target antigen is an immune checkpoint protein. Examples of immune checkpoint proteins include but are not limited to CD27, CD137, 2B4, TIGIT, CD155, ICOS, HVEM, CD40L, LIGHT, OX40, DNAM-1, PD-L1, PD1, PD-L2, CTLA-4, CD8, CD40, CEACAM1, CD48, CD70, A2AR, CD39, CD73, B7-H3, B7-H4, BTLA, IDO1, IDO2, TDO, KIR, LAG-3, TIM-3, or VISTA.

In some embodiments, a target antigen is a cell surface molecule such as a protein, lipid or polysaccharide. In some embodiments, a target antigen is a on a tumor cell, virally infected cell, bacterially infected cell, damaged red blood cell, arterial plaque cell, inflamed or fibrotic tissue cell.

In some embodiments, the target antigen comprises an immune response modulator that is not a cytokine. Examples of immune response modulator include but are not limited to B7-1 (CD80), B7-2 (CD86), CD3, or GITR.

In some embodiments, the first target antigen binding domain or the second target antigen binding domain comprises an anti-EGFR domain, an anti-EpCAM domain, an anti-DLL3 domain, an anti-MSLN domain, an anti-PSMA domain, an anti-BDMA domain, or any combinations thereof. In some embodiments, the first target antigen binding domain or the second target antigen binding domain comprises an anti-EGFR sdAb, an anti-EpCAM sdAb, an anti-DLL3 sdAb, an anti-MSLN sdAb, an anti-PSMA sdAb, an anti-BDMA sdAb, or any combinations thereof.

In some embodiments, an anti-EGFR domain of this disclosure comprises an amino acid selected from the group consisting of SEQ ID Nos. 55, and 737-785. In some embodiments, an anti-PSMA domain of this disclosure comprises an amino acid selected from the group consisting of SEQ ID Nos. 57-73. In some embodiments, an anti-BCMA domain of this disclosure comprises an amino acid selected from the group consisting of SEQ ID Nos. 91-214. In some embodiments, an anti-MSLN domain of this disclosure comprises an amino acid selected from the group consisting of SEQ ID Nos. 215-258. In some embodiments, an anti-DLL3 domain of this disclosure comprises an amino acid selected from the group consisting of SEQ ID Nos. 306-736. In some embodiments, an anti-EpCAM domain of this disclosure comprises an amino acid selected from the group consisting of SEQ ID Nos. 804-841.

In some embodiments, the first target antigen binding domain or the second target antigen binding domain comprises an anti-CD3 domain. In some embodiments, the anti-CD3 domain comprises an anti-CD3 scFV. In some embodiments, the anti-CD3 scFv comprises an amino acid sequence selected from the group consisting of: SEQ ID Nos. 74-90, and 794.

Binding Protein Variants

As used herein, the term "binding protein variants" refers to variants and derivatives of the conditionally active target-binding proteins described herein, containing a binding moiety as described above, comprising non-CDR loops that bind to an immunoglobulin binding molecule, such as a first or a second target antigen binding domain, a non-immunoglobulin binding molecule. In certain embodiments, amino acid sequence variants of the conditionally active target-binding proteins described herein are contemplated. For example, in certain embodiments amino acid sequence variants of the conditionally active target-binding proteins described herein are contemplated to improve the binding affinity and/or other biological properties of the binding proteins. Exemplary method for preparing amino acid variants include, but are not limited to, introducing appropriate modifications into the nucleotide sequence encoding the antibody, or by peptide synthesis. Such modifications include, for example, deletions from, and/or insertions into and/or substitutions of residues within the amino acid sequences of the antibody.

Any combination of deletion, insertion, and substitution can be made to the various domains to arrive at the final construct, provided that the final construct possesses the desired characteristics, e.g., antigen-binding. In certain embodiments, binding protein variants having one or more amino acid substitutions are provided. Sites of interest for substitution mutagenesis include the CDRs and framework regions. Amino acid substitutions may be introduced into the variable domains of a conditionally active protein of interest and the products screened for a desired activity, e.g., retained/improved antigen binding, decreased immunogenicity, or improved antibody-dependent cell mediated cytotoxicity (ADCC) or complement dependent cytotoxicity (CDC). Both conservative and non-conservative amino acid substitutions are contemplated for preparing the antibody variants.

In another example of a substitution to create a variant conditionally active antibody, one or more hypervariable region residues of a parent antibody are substituted. In general, variants are then selected based on improvements in desired properties compared to a parent antibody, for example, increased affinity, reduced affinity, reduced immunogenicity, increased pH dependence of binding. For example, an affinity matured variant antibody can be generated, e.g., using phage display-based affinity maturation techniques such as those described herein and known in the field.

In another example, substitutions are made in hypervariable regions (HVR) of a parent conditionally active antibody to generate variants and variants are then selected based on binding affinity, i.e., by affinity maturation. In some embodiments of affinity maturation, diversity is introduced into the variable genes chosen for maturation by any of a variety of methods (e.g., error-prone PCR, chain shuffling, or oligonucleotide-directed mutagenesis). A secondary library is then created. The library is then screened to identify any antibody variants with the desired affinity. Another method to introduce diversity involves HVR-directed approaches, in which several HVR residues (e.g., 4-6 residues at a time) are randomized. HVR residues involved in antigen binding may be specifically identified, e.g., using alanine scanning mutagenesis or modeling. Substitutions can be in one, two, three, four, or more sites within a parent antibody sequence.

In some embodiments, a conditionally active binding protein, as described herein comprises a VL domain, or a VH domain, or both, with amino acid sequences corresponding to the amino acid sequence of a naturally occurring VL or VH domain, respectively, but that has been "humanized", i.e., by replacing one or more amino acid residues in the amino acid sequence of said naturally occurring VL or VH domains (and in particular in the framework sequences) by one or more of the amino acid residues that occur at the corresponding position(s) in a VL or VH domain from a conventional 4-chain antibody from a human being (e.g., as indicated above). This can be performed in a manner known in the field, which will be clear to the skilled person, for example on the basis of the further description herein. Again, it should be noted that such humanized conditionally active target-binding antibodies of the disclosure are obtained in any suitable manner known per se and thus are not strictly limited to polypeptides that have been obtained using a polypeptide that comprises a naturally occurring VL and/or VH domain as a starting material. In some additional embodiments, an conditionally active target-binding antibody, as described herein, comprises a VL and a VH domain with amino acid sequences corresponding to the amino acid sequence of a naturally occurring VL or VH domain, respectively, but that has been "camelized", i.e., by replacing one or more amino acid residues in the amino acid sequence of a naturally occurring VL or VH domain from a conventional 4-chain antibody by one or more of the amino acid residues that occur at the corresponding position(s) in a VL or a VH domain of a heavy chain antibody. Such "camelizing" substitutions are preferably inserted at amino acid positions that form and/or are present at the VH-VL interface, and/or at the so-called Camelidae hallmark residues (see for example WO 94/04678 and Davies and Riechmann (1994 and 1996)). Preferably, the VH sequence that is used as a starting material or starting point for generating or designing the camelized single domain is preferably a VH sequence from a mammal, more preferably the VH sequence of a human being, such as a VH3 sequence. However, it should be noted that such camelized conditionally active antibodies of the disclosure, in certain embodiments, are obtained in any suitable manner known in the field and thus are not strictly limited to polypeptides that have been obtained using a polypeptide that comprises a naturally occurring VL and/or VH domain as a starting material. For example, both "humanization" and "camelization" is performed by providing a nucleotide sequence that encodes a naturally occurring VL and/or VH domain, respectively, and then changing, one or more codons in said nucleotide sequence in such a way that the new nucleotide sequence encodes a "humanized" or "camelized" conditionally active antibody, respectively. This nucleic acid can then be expressed, so as to provide the desired target-antigen binding capability. Alternatively, in other embodiments, a "humanized" or "camelized" conditionally active antibody is synthesized de novo using known peptide synthesis technique from the amino acid sequence of a naturally occurring antibody comprising a VL and/or VH domain. In some embodiments, a "humanized" or "camelized" conditionally active antibody is synthesized de novo using known peptide synthesis technique from the amino acid sequence or nucleotide sequence of a naturally occurring antibody comprising a VL and/or VH domain, respectively, a nucleotide sequence encoding the desired humanized or camelized conditionally active domain antibody of the disclosure, respectively, is designed and then synthesized de novo using known techniques for nucleic acid synthesis, after which the nucleic acid thus obtained is expressed in using known expression techniques, so as to provide the desired conditionally active antibody of the disclosure.

Other suitable methods and techniques for obtaining the conditionally active binding protein of the disclosure and/or nucleic acids encoding the same, starting from naturally occurring sequences for VL or VH domains for example comprises combining one or more parts of one or more naturally occurring VL or VH sequences (such as one or more framework (FR) sequences and/or complementarity determining region (CDR) sequences), and/or one or more synthetic or semi-synthetic sequences, and/or a naturally occurring sequence for a CH2 domain, and a naturally occurring sequence for a CH3 domain comprising amino acid substitutions that favor formation of heterodimer over homodimer, in a suitable manner, so as to provide a conditionally active binding protein of the disclosure or a nucleotide sequence or nucleic acid encoding the same.

Affinity Maturation

In designing conditionally active binding proteins for therapeutic applications, it is desirable to create proteins that, for example, modulate a functional activity of a target, and/or improved binding proteins such as binding proteins with higher specificity and/or affinity and/or and binding proteins that are more bioavailable, or stable or soluble in particular cellular or tissue environments.

The conditionally active binding proteins described in the present disclosure exhibit improved the binding affinities towards the target, for example a tumor antigen expressed on a cell surface. In some embodiments, the conditionally active binding protein of the present disclosure is affinity matured to increase its binding affinity to the target, using any known technique for affinity-maturation (e.g., mutagenesis, chain shuffling, CDR amino acid substitution). Amino acid substitutions may be conservative or semi-conservative. For example, the amino acids glycine, alanine, valine, leucine and isoleucine can often be substituted for one another (amino acids having aliphatic side chains). Of these possible substitutions, typically glycine and alanine are used to substitute for one another since they have relatively short side chains and valine, leucine and isoleucine are used to substitute for one another since they have larger aliphatic side chains which are hydrophobic. Other amino acids which may often be substituted for one another include but are not limited to: phenylalanine, tyrosine and tryptophan (amino acids having aromatic side chains); lysine, arginine and histidine (amino acids having basic side chains); aspartate and glutamate (amino acids having acidic side chains); asparagine and glutamine (amino acids having amide side chains); and cysteine and methionine (amino acids having sulphur-containing side chains). In some embodiments, the conditionally active target-binding proteins are isolated by screening combinatorial libraries, for example, by generating phage display libraries and screening such libraries for antibodies possessing the desired binding characteristics towards a target antigen, such as a tumor antigen expressed on a cell surface.

Conditionally Active Binding Protein Modifications

The conditionally active binding proteins described herein encompass derivatives or analogs in which (i) an amino acid is substituted with an amino acid residue that is not one encoded by the genetic code, (ii) the mature polypeptide is fused with another compound such as polyethylene glycol, or (iii) additional amino acids are fused to the protein, such as a leader or secretory sequence or a sequence to block an immunogenic domain and/or for purification of the protein.

Typical modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphatidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristylation, oxidation, proteolytic processing, phosphorylation, prenylation, racemization, selenoylation, sulfation, transfer-RNA mediated addition of amino acids to proteins such as arginylation, and ubiquitination.

Modifications are made anywhere in the conditionally active binding proteins described herein, including the peptide backbone, the amino acid side-chains, and the amino or carboxyl termini. Certain common peptide modifications that are useful for modification of the conditionally active binding proteins include glycosylation, lipid attachment, sulfation, gamma-carboxylation of glutamic acid residues, hydroxylation, blockage of the amino or carboxyl group in a polypeptide, or both, by a covalent modification, and ADP-ribosylation.

In some embodiments, the conditionally active binding proteins of the disclosure are conjugated with drugs to form antibody-drug conjugates (ADCs). In general, ADCs are used in oncology applications, where the use of antibody-drug conjugates for the local delivery of cytotoxic or cytostatic agents allows for the targeted delivery of the drug moiety to tumors, which can allow higher efficacy, lower toxicity, etc.

Polynucleotides Encoding the Binding Moieties or the Conditionally Active Binding Proteins Also provided, in some embodiments, are polynucleotide molecules encoding the binding moieties as described herein. In some embodiments, the polynucleotide molecules are provided as a DNA construct. In other embodiments, the polynucleotide molecules are provided as a messenger RNA transcript.

Also provided, in some embodiments, are polynucleotide molecules encoding the conditionally active binding proteins as described herein. In some embodiments, the polynucleotide molecules are provided as a DNA construct. In other embodiments, the polynucleotide molecules are provided as a messenger RNA transcript.

The polynucleotide molecules are constructed by known methods such as by combining the genes encoding the various domains (e.g. binding moiety, target antigen binding domain, etc.) either separated by peptide linkers or, in other embodiments, directly linked by a peptide bond, into a single genetic construct operably linked to a suitable promoter, and optionally a suitable transcription terminator, and expressing it in bacteria or other appropriate expression system such as, for example CHO cells. Depending on the vector system and host utilized, any number of suitable transcription and translation elements, including constitutive and conditionally active promoters, may be used. The promoter is selected such that it drives the expression of the polynucleotide in the respective host cell.

In some embodiments, the polynucleotides described herein are inserted into vectors, such as expression vectors, which represent further embodiments. This recombinant vector can be constructed according to known methods. Vectors of particular interest include plasmids, phagemids, phage derivatives, virii (e.g., retroviruses, adenoviruses, adeno-associated viruses, herpes viruses, lentiviruses, and the like), and cosmids.

A variety of expression vector/host systems may be utilized to contain and express the polynucleotide encoding the polypeptide of the described conditionally active binding protein. Examples of expression vectors for expression in *E. coli* are pSKK (Le Gall et al., J Immunol Methods. (2004) 285(1):111-27) or pcDNA5 (Invitrogen) for expression in mammalian cells.

Thus, the binding moieties or the conditionally active binding proteins comprising the binding moieties as described herein, in some embodiments, are produced by introducing vectors encoding the binding moieties or the binding proteins as described above into host cells and culturing said host cells under conditions whereby the binding moieties or the binding proteins, or domains thereof are expressed.

Pharmaceutical Compositions

Also provided, in some embodiments, are pharmaceutical compositions comprising a therapeutically effective amount of a conditionally active binding protein of the present disclosure, and at least one pharmaceutically acceptable carrier. The term "pharmaceutically acceptable carrier" includes, but is not limited to, any carrier that does not interfere with the effectiveness of the biological activity of the ingredients and that is not toxic to the patient to whom it is administered. Examples of suitable pharmaceutical carriers are well known in the art and include phosphate buffered saline solutions, water, emulsions, such as oil/water emulsions, various types of wetting agents, sterile solutions etc. Such carriers can be formulated by conventional methods and can be administered to the subject at a suitable dose. Preferably, the compositions are sterile. These compositions may also contain adjuvants such as preservative, emulsifying agents and dispersing agents. Prevention of the action of microorganisms is, in some cases, ensured by the inclusion of various antibacterial and antifungal agents.

The conditionally active binding proteins described herein are contemplated for use as medicaments. Administration is effected by different ways, e.g., by intravenous, intraperitoneal, subcutaneous, intramuscular, topical or intradermal administration. In some embodiments, the route of administration depends on the kind of therapy and the kind of compound contained in the pharmaceutical composition. The dosage regimen will be determined by the attending physician and other clinical factors. Dosages for any one patient depends on many factors, including the patient's size, body surface area, age, sex, the particular compound to be administered, time and route of administration, the kind of therapy, general health and other drugs being administered concurrently. An "effective dose" refers to amounts of the active ingredient that are sufficient to affect the course and the severity of the disease, leading to the reduction or remission of such pathology and may be determined using known methods.

Methods of Treatment

Also provided herein, in some embodiments, are methods and uses for stimulating the immune system of an individual in need thereof comprising administration of a conditionally active binding protein as described herein. In some instances, administration induces and/or sustains cytotoxicity towards a cell expressing a target antigen. In some instances, the cell expressing a target antigen is a cancer or tumor cell, a virally infected cell, a bacterially infected cell, an autoreactive T or B cell, damaged red blood cells, arterial plaques, or fibrotic tissue. In some embodiments, the target antigen is an immune checkpoint protein.

Also provided herein are methods and uses for a treatment of a disease, disorder or condition associated with a target antigen comprising administering to an individual in need thereof a conditionally active binding protein as described herein. Diseases, disorders or conditions associated with a target antigen include, but are not limited to, viral infection, bacterial infection, auto-immune disease, transplant rejection, atherosclerosis, or fibrosis. In other embodiments, the disease, disorder or condition associated with a target antigen is a proliferative disease, a tumorous disease, an inflammatory disease, an immunological disorder, an autoimmune disease, an infectious disease, a viral disease, an allergic reaction, a parasitic reaction, a graft-versus-host disease or a host-versus-graft disease. In one embodiment, the disease, disorder or condition associated with a target antigen is cancer. In one instance, the cancer is a hematological cancer. In another instance, the cancer is a melanoma. In a further instance, the cancer is non-small cell lung cancer. In yet further instance, the cancer is breast cancer.

As used herein, in some embodiments, "treatment" or "treating" or "treated" refers to therapeutic treatment wherein the object is to slow (lessen) an undesired physiological condition, disorder or disease, or to obtain beneficial or desired clinical results. For the purposes described herein, beneficial or desired clinical results include, but are not limited to, alleviation of symptoms; diminishment of the extent of the condition, disorder or disease; stabilization (i.e., not worsening) of the state of the condition, disorder or disease; delay in onset or slowing of the progression of the condition, disorder or disease; amelioration of the condition, disorder or disease state; and remission (whether partial or total), whether detectable or undetectable, or enhancement or improvement of the condition, disorder or disease. Treatment includes eliciting a clinically significant response without excessive levels of side effects. Treatment also includes prolonging survival as compared to expected survival if not receiving treatment. In other embodiments, "treatment" or "treating" or "treated" refers to prophylactic measures, wherein the object is to delay onset of or reduce severity of an undesired physiological condition, disorder or disease, such as, for example is a person who is predisposed to a disease (e.g., an individual who carries a genetic marker for a disease such as breast cancer).

In some embodiments of the methods described herein, the conditionally active binding proteins described herein are administered in combination with an agent for treatment of the particular disease, disorder or condition. Agents include but are not limited to, therapies involving antibodies, small molecules (e.g., chemotherapeutics), hormones (steroidal, peptide, and the like), radiotherapies (y-rays, X-rays, and/or the directed delivery of radioisotopes, microwaves, UV radiation and the like), gene therapies (e.g., antisense, retroviral therapy and the like) and other immunotherapies. In some embodiments, the conditionally active binding proteins described herein are administered in combination with anti-diarrheal agents, anti-emetic agents, analgesics, opioids and/or non-steroidal anti-inflammatory agents. In some embodiments, the conditionally active binding proteins described herein is administered before, during, or after surgery.

EXAMPLES

The examples below further illustrate the described embodiments without limiting the scope of the disclosure.

Example 1: Construction of an Exemplary Binding Moiety which Binds to Albumin and a Target Antigen Binding Domain Whose Target is EGFR The sequence of an engineered protein scaffold comprising CDR loops capable of binding albumin and non-CDR loops is obtained. Overlapping PCR is used to introduce random mutations in the non-CDR loop regions, thereby generating a library. The resultant sequences are cloned into a phage display vector, thereby generating a phage display library. *Escherichia coli* cells are transformed with the library and used to construct a phage display library. ELISA is performed using an immobilized target antigen binding domain with specificity for EGFR. A clone with high specificity for EGFR is selected. Affinity maturation is performed by re-randomizing residues in the non-CDR loop regions as before.

Sequence alignment of non-CDR loop regions of the resultant proteins is performed to determine sequence conservation between proteins with high affinity for the EGFR binding target antigen binding domain. Site directed mutagenesis of one or more amino acids within these regions of sequence conservation is performed to generate additional proteins. Binding of the resultant proteins to an immobilized target antigen binding domain whose target is EGFR is measured in an ELISA. A protein with the highest affinity for the target antigen binding domain is selected.

The sequence of this binding moiety is cloned into a vector comprising a sequence for a cleavable linker, and sequences for a second target antigen binding domain that binds to a second target antigen, e.g., CD3. The resultant vector is expressed in a heterologous expression system to obtain a conditionally active target binding protein that comprises a binding moiety comprising a cleavable linker and non-CDR loops which provide a binding site specific for the target antigen binding domain whose target is EGFR, and CDR loops which are specific for albumin.

Example 2: Construction of an Exemplary Binding Moiety which Binds to Albumin and a Target Antigen Binding Domain Whose Target is CD3

Figure 5:
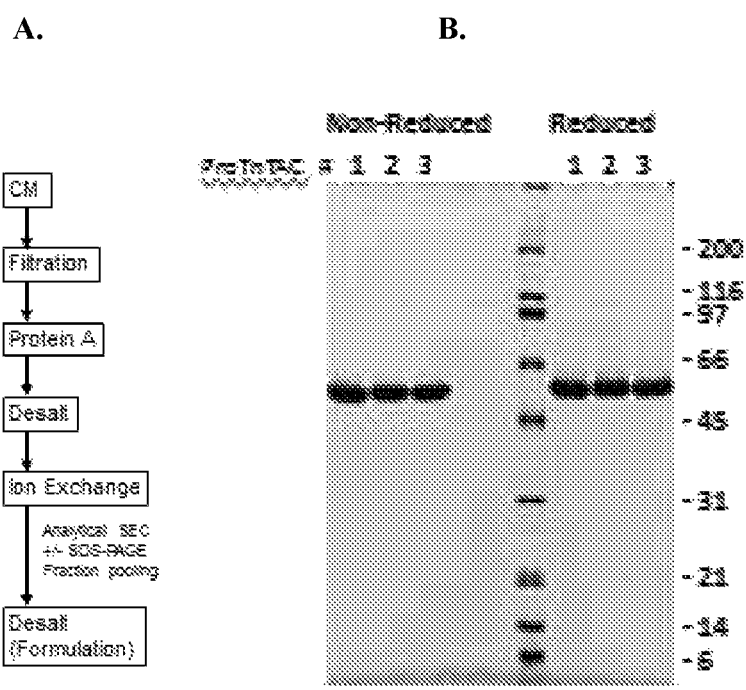

The sequence of an engineered protein scaffold comprising CDR loops capable of binding albumin and non-CDR loops is obtained. Overlapping PCR is used to introduce random mutations in the non-CDR loop regions, thereby generating a library. The resultant sequences are cloned into a phage display vector, thereby generating a phage display library. *Escherichia coli* cells are transformed with the library and used to construct a phage display library. ELISA is performed using an immobilized target antigen binding domain with specificity for CD3. A clone with high specificity for CD3 is selected. Affinity maturation is performed by re-randomizing residues in the non-CDR loop regions as before.

Sequence alignment of non-CDR loop regions of the resultant proteins is performed to determine sequence conservation between proteins with high affinity for the EGFR binding target antigen binding domain. Site directed mutagenesis of one or more amino acids within these regions of sequence conservation is performed to generate additional proteins. Binding of the resultant proteins to an immobilized target antigen binding domain whose target is CD3 is measured in an ELISA. A protein with the highest affinity for the target antigen binding domain is selected.

The sequence of this binding moiety is cloned into a vector comprising a sequence for a cleavable linker, and sequences for a second target antigen binding domain that binds to a second target antigen, e.g., EGFR. The resultant vector is expressed in a heterologous expression system to obtain a conditionally active target binding protein that comprises a binding moiety comprising a cleavable linker and non-CDR loops which provide a binding site specific for the target antigen binding domain whose target is CD3, and CDR loops which are specific for albumin.

Example 3: A Conditionally Active Binding Protein of this Disclosure Exhibit Reduced Specificity Toward Cell Line which Overexpresses EGFR but is Protease Deficient Cells overexpressing EGFR and exhibiting low expression of a matrix metalloprotease are separately incubated with an exemplary conditionally active binding protein according to the present disclosure and a non-conditionally active control binding protein. Cells expressing normal levels of EGFR and proteases are also incubated with a conditionally active binding protein according to the present disclosure and a non-conditionally active control binding protein. Both proteins comprise a target antigen binding domain with specificity toward PSMA.

Results indicate that in the absence of protease secretion, the conditionally active binding protein of the present disclosure interacts with the protease expressing cells but does not interact with the EGFR expressed on the surface of the protease deficient cells. In contrast, the non-conditionally active control binding protein lacks the ability to selectively bind the protease expressing cells over the protease deficient ones. Thus, the exemplary conditionally active binding protein receptor of the present disclosure is advantageous, for example, in terms of reducing off-tumor toxicity.

Example 4: Treatment with an Exemplary Conditionally Active Binding Protein of the Present Disclosure Inhibits In Vivo Tumor Growth Murine tumor line CT26 is implanted subcutaneously in Balb/c mice and on day 7 post-implantation the average size of the tumor is measured. Test mice are treated with an exemplary conditionally active binding protein which has a target antigen binding domain specific for CTLA4 and another target antigen binding domain specific for CD3, wherein either the CTLA4 or the CD3 specific domain is bound to a binding moiety via its non-CDR loops, the binding moiety comprises a cleavable linker, and is bound to albumin. Control mice are treated with binding protein that contains CD3/CTLA4 specific domains but do not contain the binding moiety or the cleavable linker, and are not conditionally active. Results show that treatment with the exemplary conditionally active binding protein of the present disclosure inhibits tumor more efficiently than the comparator binding protein which does not contain the moiety with non-CDR loops.

Example 5: Exemplary Conditionally Active Binding Protein Exhibits Reduced Specificity Toward Cell Line which Overexpresses Antigen but is Protease Deficient Cells overexpressing CTLA-4 and exhibiting low expression of a matrix metalloprotease are separately incubated with an exemplary CTLA4 specific conditionally active binding protein of this disclosure, containing a binding moiety that binds to a CTLA4 binding domain via its non-CDR loops and albumin via its CDRs; or a control CTLA-4 binding antibody which does not contain the binding moiety which binds to a CTLA4 binding domain via its non-CDR loops and to albumin via its CDRs. Cells expressing normal levels of antigens and proteases are also incubated with the exemplary CTLA4 specific conditionally active binding protein, or the control CTLA4 binding antibody.

Results indicate that in the absence of protease secretion, the conditionally active binding protein of the present disclosure binds the protease expressing cells but does not bind the protease-deficient antigen expressing cells. In contrast, the control antibody lacks the ability to selectively bind the protease expressing cells over the protease deficient ones. Thus, the exemplary conditionally active binding protein of the present disclosure is advantageous, for example, in terms of reducing off-tumor toxicity.

Example 6: Purification, Pharmacokinetic Analysis, and Potency Assays for Exemplary ProTriTAC Molecules A) Expression, Purification and Stability of Exemplary ProTriTAC Molecules Protein Production Sequences of exemplary ProTriTAC (also referred to as Pro-trispecific) molecules were cloned into mammalian expression vector pcDNA 3.4 (Invitrogen) preceded by a leader sequence and followed by a 6× Histidine Tag (SEQ ID NO: 927). Expi293F cells (Life Technologies A14527) were maintained in suspension in Optimum Growth Flasks (Thomson) between 0.2 to 8×1e6 cells/ml in Expi 293 media. Purified plasmid DNA was transfected into Expi293 cells in accordance with Expi293 Expression System Kit (Life Technologies, A14635) protocols, and maintained for 4-6 days post transfection. Alternatively, sequences of trispecific molecules were cloned into mammalian expression vector pDEF38 (CMC ICOS) transfected into CHO-DG44 dhfr-cells, stable pools generated, and cultured in production media for up to 12 days prior to purification. The amount of the exemplary trispecific proteins in conditioned media was quantitated using an Octet RED 96 instrument with Protein A tips (ForteBio/Pall) using a control trispecific protein for a standard curve. Conditioned media from either host cell was filtered and partially purified by affinity and desalting chromatography. Trispecific proteins were subsequently polished by ion exchange and upon fraction pooling formulated in a neutral buffer containing excipients. Final purity was assessed by SDS-PAGE and analytical SEC using an Acquity BEH SEC 200 1.7u 4.6×150 mm column (Waters Corporation) resolved in an aqueous/organic mobile phase with excipients at neutral pH on a 1290 LC system and peaks integrated with Chemstation CDS software (Agilent). Trispecific proteins purified from CHO host cells were analyzed by running an SDS-PAGE, as shown in FIG. 5.

Stability Assessment

Figures 6A, 6B:
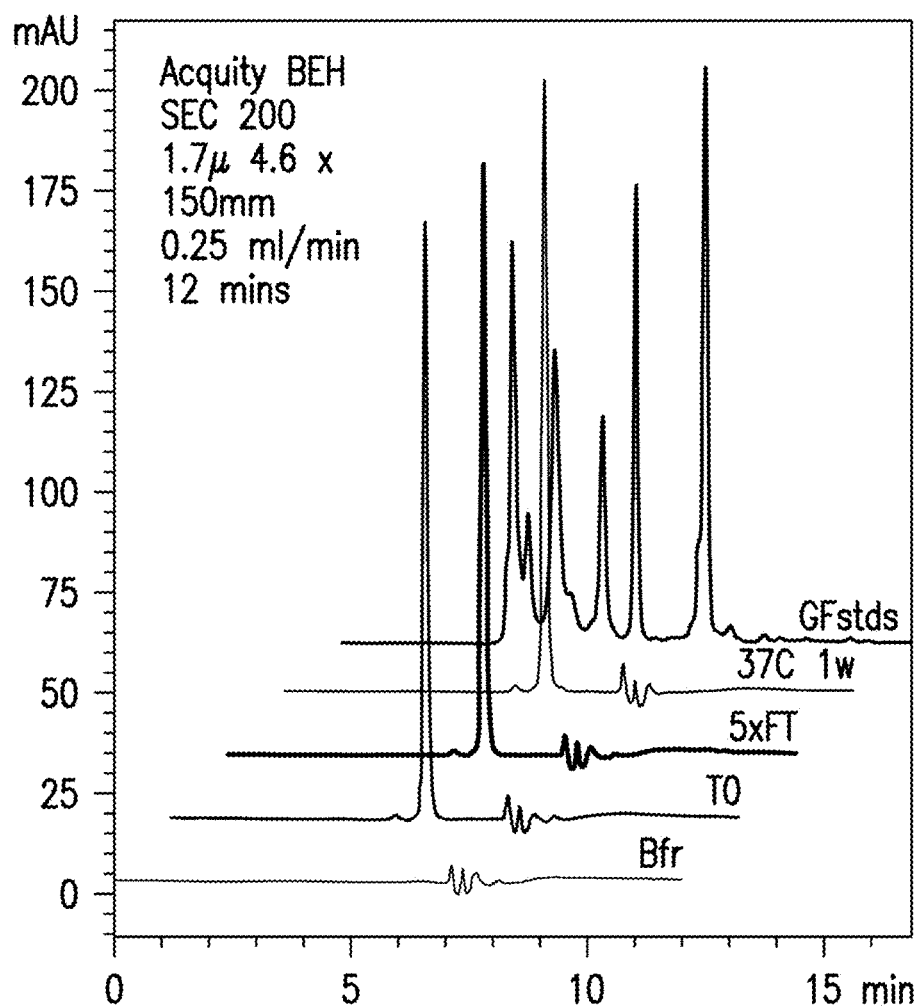
FIGS. 6A-B show analytical size exclusion chromatograms on a ProTriTAC molecule exposed to different stress conditions in graph form in FIG. 6A with the corresponding data in FIG. 6B.

Purified Protrispecific proteins in two formulations were sub-aliquoted into sterile tubes and stressed by five freeze-thaw cycles each comprising greater than 1 hour at −80° C. and room temperature or by incubation at 37° C. for 1 week. Stressed samples were evaluated for concentration and turbidity by UV spectrometry using UV transparent 96 well plates (Corning 3635) with a SpectraMax M2 and SoftMax-Pro Software (Molecular Devices), SDS-PAGE, and analytical SEC and compared to the same analysis of control non-stressed samples. An overlay of chromatograms from analytical SEC of control and stressed samples for a single exemplary trispecific ProTriTAC molecule purified from 293 host cells is depicted in FIG. 6.

Figure 7:
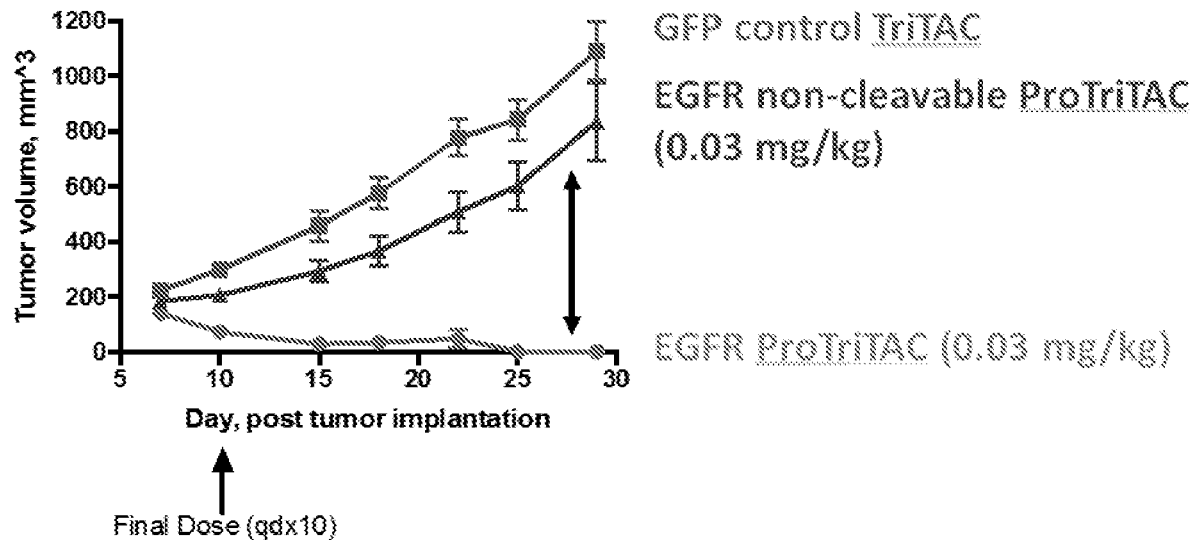
FIG. 7 shows protease-dependent, anti-tumor activity of exemplary ProTriTAC molecules in HCT116 Colorectal Tumor Xenograft Model in NSG Mice.

B) ProTriTAC Exhibits Potent, Protease-Dependent, Anti-Tumor Activity in a Rodent Tumor Xenograft Model An exemplary ProTriTAC molecule (SEQ ID NO: 46) containing an EGFR binding domain as the target binding domain, a CD3 binding domain and an albumin binding domain comprising a masking moiety (SEQ ID NO: 50) and a cleavable linker (SEQ ID NO: 53) was evaluated for anti-tumor activity in vivo in an HCT116 subcutaneous xenograft tumor admixed with expanded human T cells in immunocompromised NCG mice. A non-cleavable EGFR targeting ProTriTAC molecule (SEQ ID NO: 47) and a GFP targeting ProTriTAC molecule (SEQ ID NO: 49) were also used in the study. Specifically, 5×10⁶ HCT116 cells were admixed with 2.5×10⁶ expanded T cells per mouse on day 0. Dosing of the test molecules (EGFR targeting ProTriTAC, non-cleavable EGFR targeting Pro-TriTAC, and GFP targeting ProTriTAC) were performed starting on the following day with a q.d.×10 (single daily dose for 10 days) schedule via intraperitoneal injection, at a dose of 0.03 mg/kg. Tumor volumes were determined using caliper measurements and calculated using the formula V=(length×width×width)/2, at the indicated times. Results shown in FIG. 7 indicate that following final dose of test molecules, on day 10, tumor growth was arrested in mice administered the activatable EGFR targeting ProTriTAC molecule. Whereas, administering the GFP targeting ProTriTAC molecule was not effective in inhibiting tumor growth and the administration of the EGFR targeting non-cleavable ProTriTAC molecule was not as potent as the activatable ProTriTAC, in arresting tumor growth.

Figure 8:
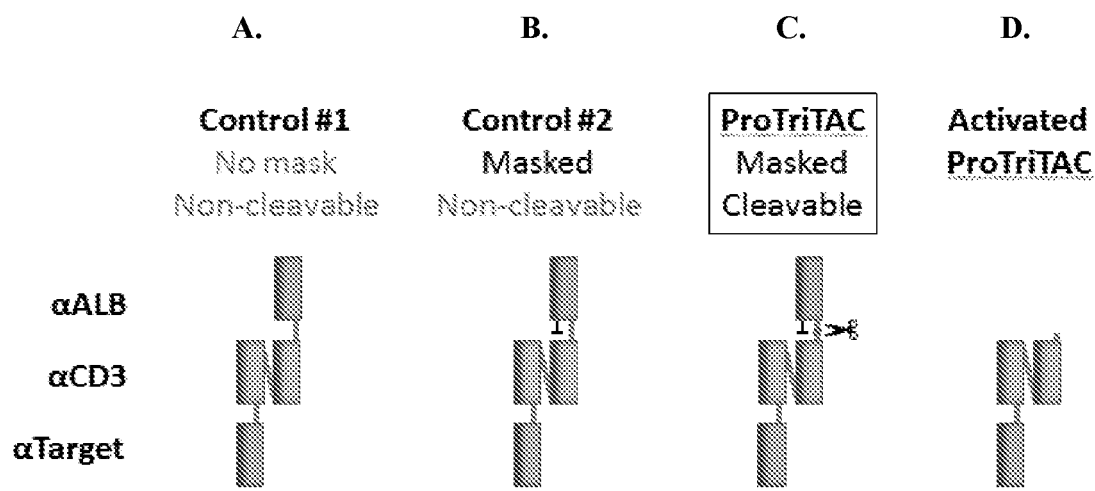
FIGS. 8A-8D show various designs of exemplary ProTriTAC and control molecules.
Figure 9:
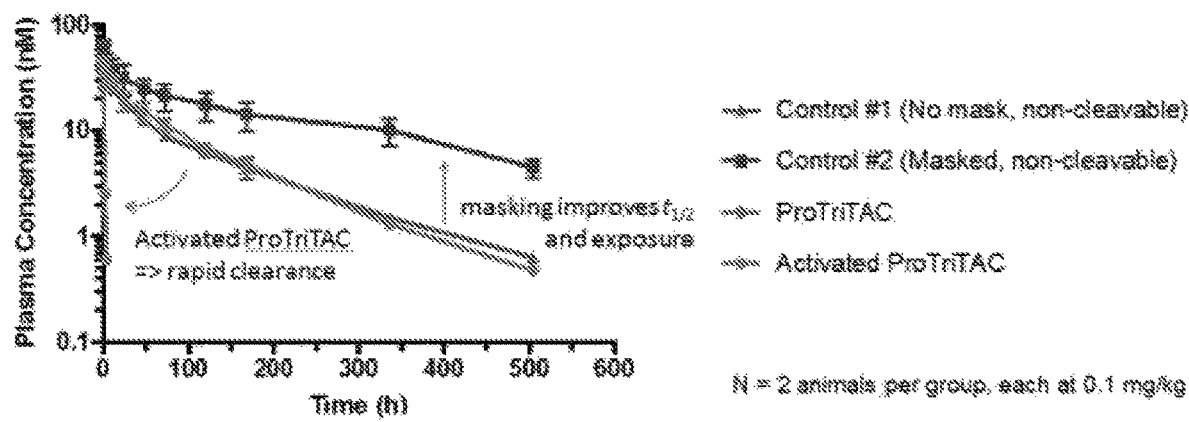
FIG. 9 shows pharmacokinetic profiles for exemplary ProTriTAC and control molecules.

C) Demonstration of Functional Masking and Stability of ProTriTAC In Vivo in a Three-Week Cynomolgus Monkey Pharmacokinetic Study Single doses of PSMA targeting ProTriTAC (SEQ ID NO: 43) containing a PSMA binding domain as the target binding domain, a CD3 binding domain, and an albumin binding domain comprising a masking moiety (SEQ ID NO: 50) and a cleavable linker (SEQ ID NO: 53), non-cleavable PSMA targeting ProTriTAC (SEQ ID NO: 44), non-masked/non-cleavable TriTAC (SEQ ID NO: 52), and active drug mimicking protease-activated PSMA targeting ProTriTAC (SEQ ID NO: 45) were dosed into cynomolgus monkeys at 0.1 mg/kg via intravenous injection. Plasma samples were collected at the time points indicated in FIG. 9. The designs of the above described test molecules are shown in FIG. 8. Concentrations of the various test molecules, as described above, were determined using ligand binding assays with biotinylated recombinant human PSMA (R&D systems) and sulfo-tagged anti-CD3 idiotype antibody cloned 11D3 in a MSD assay (Meso Scale Diagnostic, LLC). Pharmacokinetic parameters were estimated using Phoenix WinNonlin pharmacokinetic software using a non-compartmental approach consistent with the intravenous bolus route of administration.

To calculate the rate of in vivo conversion of the test molecules (i.e., conversion of PSMA targeting ProTriTAC, non-cleavable PSMA targeting ProTriTAC, non-masked/non-cleavable PSMA targeting ProTriTAC) the concentration of active drug in circulation was estimated by solving the following system of differential equations where P is the concentration of prodrug, A is the concentration of active drug, $k_a$ is the rate of prodrug activation in circulation, $k_{c,P}$ is the clearance rate of the prodrug, and $k_{c,A}$ is the clearance rate of the active drug.

$$\frac{dP}{dt} = -k_{c,P} P$$

$$\frac{dA}{dt} = k_a P - k_{c,A} A$$

The clearance rates of the prodrug, active drug, non-masked non-cleavable prodrug control, and a non-cleavable prodrug control ($k_{c,NCLV}$) were determined empirically in cynomolgus monkeys. To estimate the rate of prodrug activation in circulation, it was assumed that the difference between the clearance rate of cleavable prodrug and the non-cleavable prodrug arose solely from non-specific activation in circulation. Therefore, the rate of prodrug conversion to active drug in circulation was estimated by subtracting the clearance rate of the cleavable prodrug from the non-cleavable prodrug.

$$k_a = k_{c,NCLV} - k_{c,P}$$

Figure 10:
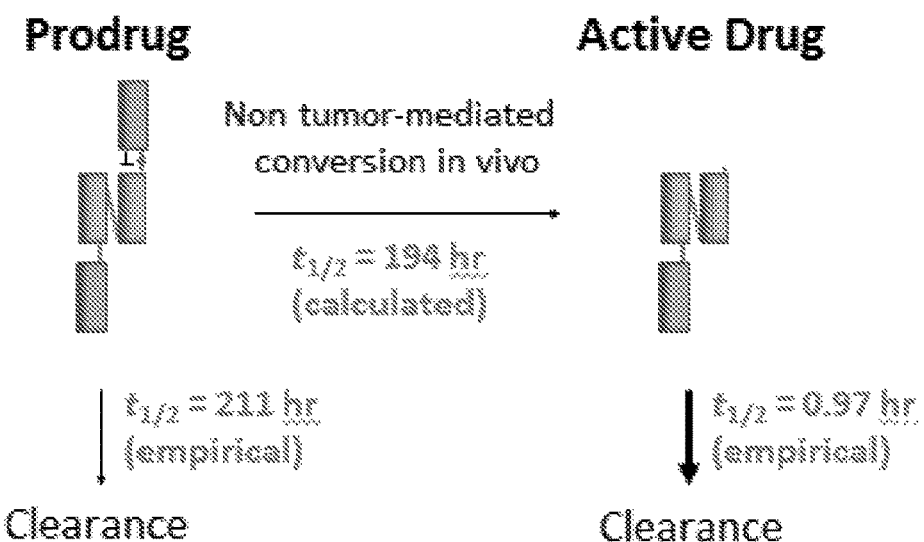
FIG. 10 shows conversion and half-life of exemplary ProTriTAC molecule.

The initial concentration of prodrug in circulation was determined empirically and the initial concentration of active drug was assumed to be zero. Further calculations showed that the ProTriTAC comprising the protease cleavable linker was sufficiently stable in circulation, with 50% non-tumor mediated conversion every 194 hours and the $t_{1/2}$ of the molecule was determined, empirically, to be around 211 hours. This indicated that ProTriTAC molecules are sufficiently stable and protected against off-tumor effects. In contrast, the $t_{1/2}$ of the active drug fragment mimicking the activated ProTRITAC molecule was determined, empirically, to be 0.97 hours. Thus, active drug was rapidly cleared from circulation. Results are shown in FIG. 10.

Figure 11:
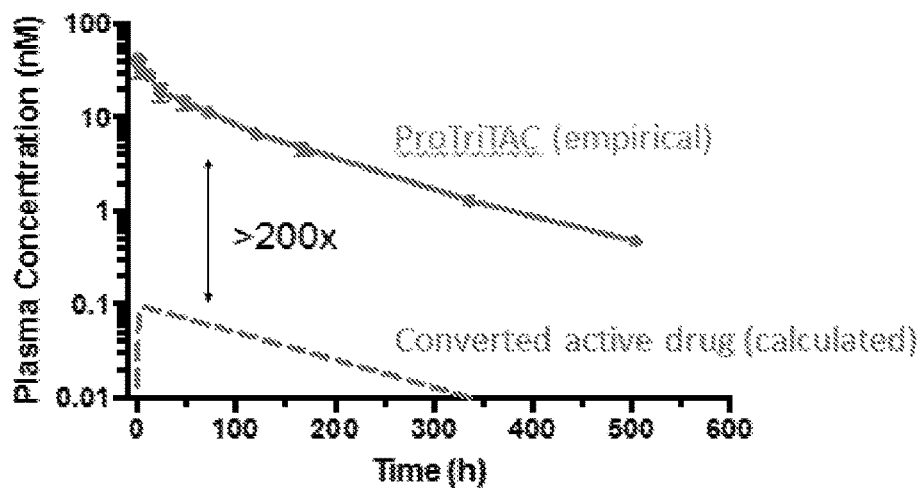
FIG. 11 shows plasma clearance of an exemplary ProTriTAC molecule and its converted active drug format.

FIG. 11 shows that because the active drug mimicking the activated ProTriTAC molecule was rapidly cleared from circulation and that the ProTriTAC and the control non-masked non-cleavable ProTriTAC had longer half-lives, there is a significant >200-fold differential between the ProTriTAC and the activated ProTriTAC circulating exposure. It was also observed that the masked but non-cleavable ProTriTAC control molecule was present in circulation for a longer time than the non-masked non-cleavable ProTriTAC control, thereby indicating that masking plays a role in increased circulation half-life ($t_{1/2}$) and limited peripheral T cell binding. The combination of the functional masking that renders ProTriTAC inert outside the tumor environment and the half-life differential that renders any aberrantly activated ProTriTAC in circulation to be rapidly cleared in vivo works together to ensure on-target, off-tumor activity of ProTriTAC is minimized. Supporting pharmacokinetic parameters are shown in Table 5.

TABLE 5

Pharmacokinetics of ProTriTAC, Activated ProTriTAC and Control Molecules

| Test Article | Terminal $t_{1/2}$ (hr) | $C_{max}$ (nM) | AUC, 0-last (hr*nM) | Clearance (mL/hr/kg) |
|---|---|---|---|---|
| Control #1 (No mask, non-cleavable) | 118 | 48.2 | 2490 | 0.735 |
| Control #2 (Masked, non-cleavable) | 211 | 58.0 | 7000 | 0.238 |
| ProTriTAC | 101 | 42.7 | 2670 | 0.686 |
| Activated ProTriTAC | 0.969 | 66.6 | 41.5 | 58.5 |

D) Protease Activation of ProTriTAC Molecule Leads to Significantly Enhanced Activity In Vitro The aim of this study was to assess the relative potency of protease activatable ProTriTAC molecules, non-cleavable ProTriTAC molecules and recombinant active drug fragment mimicking the protease-activated ProTriTAC molecule, in CD3 binding and T cell mediated cell killing. The active drug fragment mimicking the protease activated ProTriTAC molecule contained the CD3 binding domain and the target antigen binding domain but lacked the albumin binding domain. Whereas the protease activatable ProTriTAC molecule contained the albumin binding domain comprising a masking domain and a protease cleavable site, the CD3 binding domain, and the target antigen binding domain. The non-cleavable ProTriTAC molecule lacked the protease cleavable site but was otherwise identical to the protease activatable ProTriTAC molecule.

Figure 12:
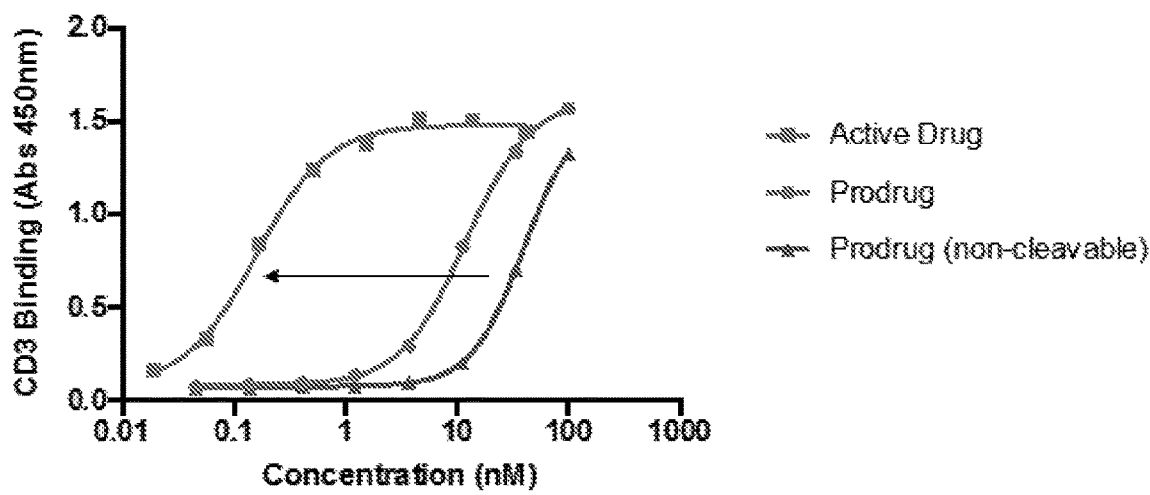
FIG. 12 shows CD3 binding potential of an exemplary ProTriTAC molecule, its converted active drug format, and a control non-cleavable ProTriTAC molecule.
Figure 13:
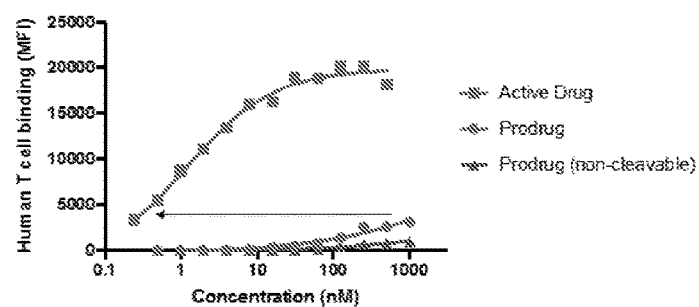
FIG. 13 shows human primary T cell binding potential of an exemplary ProTriTAC molecule, its converted active drug format, and a control non-cleavable ProTriTAC molecule.
Figure 14:
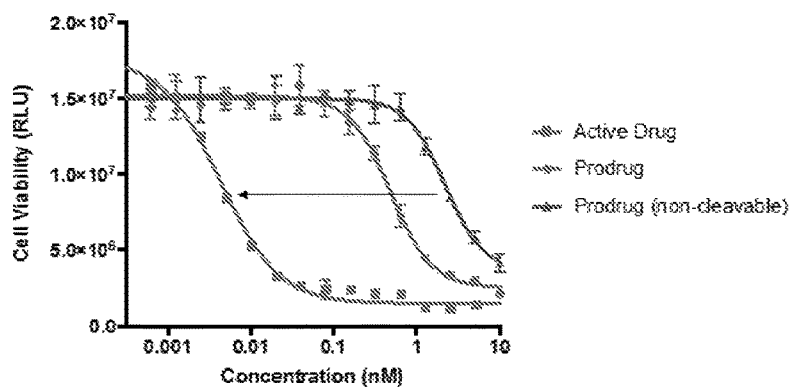
FIG. 14 shows T cell killing potential of an exemplary ProTriTAC molecule, its converted active drug format, and a control non-cleavable ProTriTAC molecule.

Purified ProTriTAC (labeled as prodrug in FIGS. 12-14), non-cleavable ProTriTAC (labeled as prodrug (non-cleavable) in FIGS. 12-14), and recombinant active drug fragment mimicking the protease-activated ProTriTAC (labeled as active drug in FIGS. 12-14) were tested for binding to recombinant human CD3 in an ELISA assay (FIG. 12), binding to purified human primary T cells in a flow cytometry assay (FIG. 13), and functional potency in a T cell-dependent cellular cytotoxicity assay (FIG. 14).

For ELISA, soluble test molecules (i.e., active drug, prodrug, and prodrug (non-cleavable)) at the indicated concentrations were incubated, in multi-well plates, with immobilized recombinant human CD3ε (R&D Systems) for 1 hour at room temperature in PBS supplemented with 15 mg/mL human serum albumin. Plates were blocked using SuperBlock (Thermo Fisher), washed using PBS with 0.05% Tween-20, and detected using a non-competitive anti-CD3 idiotype monoclonal antibody 11D3 followed by peroxidase-labeled secondary antibody and TMB-ELISA substrate solution (Thermo Fisher). Results shown in FIG. 12 demonstrate that the active drug fragment mimicking the protease-activated ProTriTAC molecule was about 250 times more potent in binding CD3 as compared to prodrug non-cleavable. The $EC_{50}$ values are provided in Table 6. The masking ratio is the ratio between the prodrug $EC_{50}$ over the active drug $EC_{50}$: the higher the number, the higher the fold-shift between prodrug and active drug and thus greater functional masking.

TABLE 6

CD3 binding potential

|  | $EC_{50}$ (nM) | Masking Ratio |
|---|---|---|
| Active Drug | 0.16 | — |
| Prodrug | 11.91 | 74 |
| Prodrug (non-cleavable) | 39.44 | 247 |

For binding to human primary T cells, determined by flow cytometry, soluble test molecules (i.e., active drug, prodrug, and prodrug (non-cleavable)) at the indicated concentrations (shown in FIG. 13) were incubated, in multi-well plates, with purified human primary T cells for 1 h at 4° C. in the presence of PBS with 2% fetal bovine serum and 15 mg/ml human serum albumin. Plates were washed with PBS with 2% fetal bovine serum, detected using AlexaFluor 647-labeled non-competitive anti-CD3 idiotype monoclonal antibody 11D3, and data was analyzed using FlowJo 10 (FlowJo, LLC). Results shown in FIG. 13 demonstrate that the active drug fragment mimicking the protease-activated ProTriTAC molecule was greater than 1000 times more potent in binding human primary T cells as compared to prodrug non-cleavable. The $EC_{50}$ values are provided in Table 7.

TABLE 7

Human primary T cell binding potential

|  | $EC_{50}$ (nM) | Masking Ratio |
|---|---|---|
| Active Drug | 1.19 | — |
| Prodrug | >1000 | n/a |
| Prodrug (non-cleavable) | >1000 | n/a |

For functional potency in a T cell-dependent cellular cytotoxicity assays, soluble test molecules (i.e., active drug, prodrug, and prodrug (non-cleavable)) at the indicated concentrations, shown in FIG. 14, were incubated, in multi-well plates, with purified resting human T cells (effector cell) and HCT116 cancer cell (target cell) at 10:1 effector:target cell ratio for 48 h at 37° C. The HCT116 target cell line had been stably transfected with a luciferase reporter gene to allow specific T cell-mediated cell killing measurement by ONE-Glo (Promega). Results shown in FIG. 14 demonstrate that the active drug fragment mimicking the protease-activated ProTriTAC molecule was about 500 times more potent in T cell mediated killing of cancer cells, as compared to prodrug non-cleavable. The $EC_{50}$ values are provided in Table 8.

TABLE 8

T cell mediated cell killing potential

| | EC$_{50}$ (nM) | Masking Ratio |
|---|---|---|
| Active Drug | 0.004 | — |
| Prodrug | 0.485 | 121 |
| Prodrug (non-cleavable) | 2.197 | 549 |

Example 7: Anti-Tumor Activity of Exemplary ProTriTAC Molecules Containing Various Exemplary Linkers, in an Admixed Mouse Tumor Model The aim of this study was to explore the anti-tumor activity of ProTriTAC molecules containing different linkers. NSG female mice, 7 weeks old, were used for this study. At the commencement of the study, on day 0, the NSG female mice were injected with 2.5×10$^6$ expanded human T cells, and 5×10$^6$ HCT116 (human colorectal carcinoma) tumor cells. The following day, on day 1, the mice were divided into groups and each group was treated with at least one of the ProTriTAC molecules listed in Table 9 (SEQ ID Nos. 786-790), or with a control GFP TriTAC molecule (SEQ ID No. 792), or with a ProTriTAC molecule that contains a non cleavable linker (NCLV) (SEQ ID No. 791). The ProTriTAC molecules and the ProTriTAC NCLV molecule used in the following examples were targeted to EGFR and had the following orientation of the individual domains: (anti-albumin binding domain (sdAb): anti-CD3 domain (scFV): anti-EGFR domain (sdAb)). The only differences between the ProTriTAC molecules listed in Table 6 were in the linker sequences. The ProTriTAC molecules, ProTriTAC NCLV molecule, or the GFP TriTAC molecule (the GFP TriTAC molecule had the following orientation of individual domains: anti-GFP sdAb: anti-Alb sdAb: anti-CD3 scFv) were administered daily for a period of 10 days (i.e., final dose was administered on day 10 following injection of tumor cells and expanded cells to the animals) and tumor volumes were measured at regular intervals, beginning a few days prior to the administration of the final dose at day 10.

TABLE 9

ProTriTAC sequences and linkers

| ProTriTAC molecule sequence | Linker in the ProTriTAC molecule | Linker Sequence | Cleavability/ Recognition of the linker sequence by enzymes |
|---|---|---|---|
| SEQ ID No. 786 | L001 (SEQ ID NO: 58) | KPLGLQARVV | MMP9 + matriptase |
| SEQ ID No. 787 | L040 (SEQ ID NO: 59) | PQASTGRSGG | MMP9 + matriptase + uPA |
| SEQ ID No. 788 | L041 (SEQ ID NO: 60) | PQGSTGRAAG | MMP9 + matriptase + uPA |
| SEQ ID No. 789 | L042 (SEQ ID NO: 61) | PPASSGRAGG | matriptase + uPA |
| SEQ ID No. 790 | L045 (SEQ ID NO: 62) | PIPVQGRAH | MMP9 + matriptase |
| | L043 (SEQ ID NO: 909) | PQGSTARSAG | MMP9 + matriptase |

Figure 18:
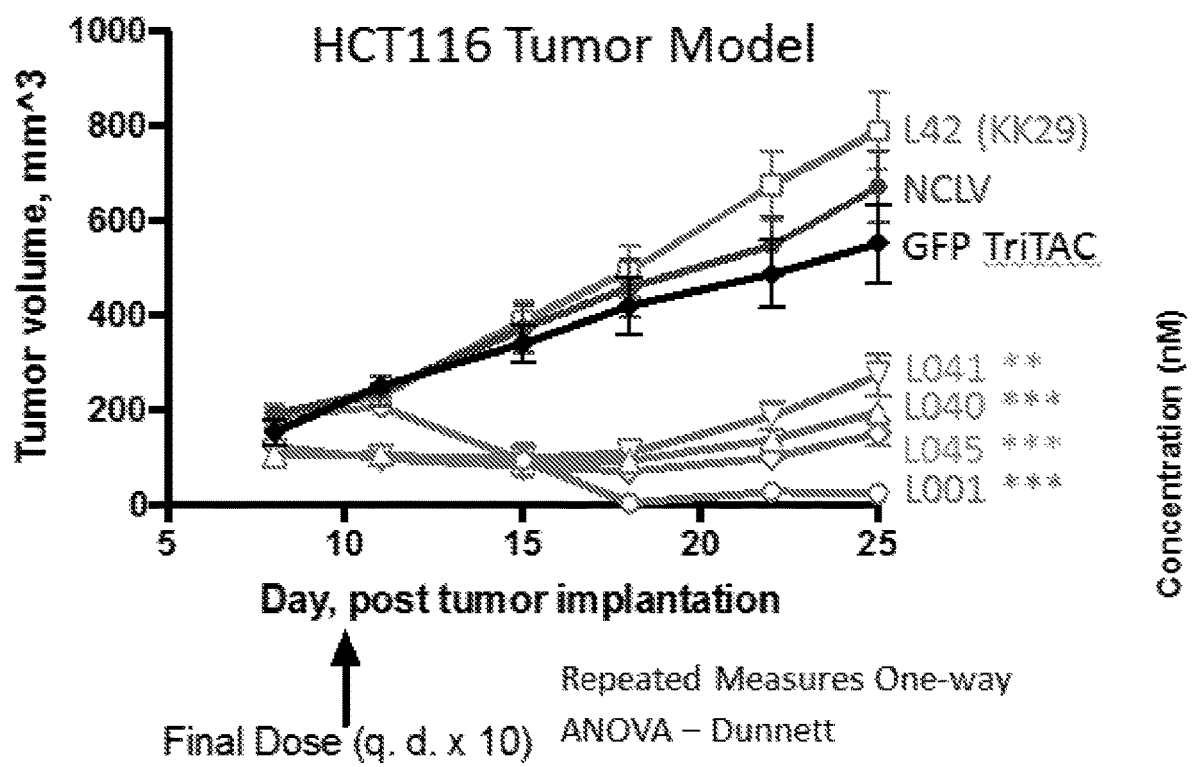
FIG. 18 shows anti-tumor activity of exemplary ProTriTAC molecules and TriTAC molecules of this disclosure.

As shown in FIG. 18, the ProTriTAC molecules containing linker sequences L001, L045, L040, and L041 demonstrated more potent anti-tumor activity as compared to the GFP TriTAC control of the ProTriTAC NCLV molecule. The statistical significance of the data was determined by repeated measures one-way ANOVA-Dunnett post test. The mean tumor volume of each group of mice were compared to the mean tumor volume of the mice group that received the NCLV molecule.

Figure 19:
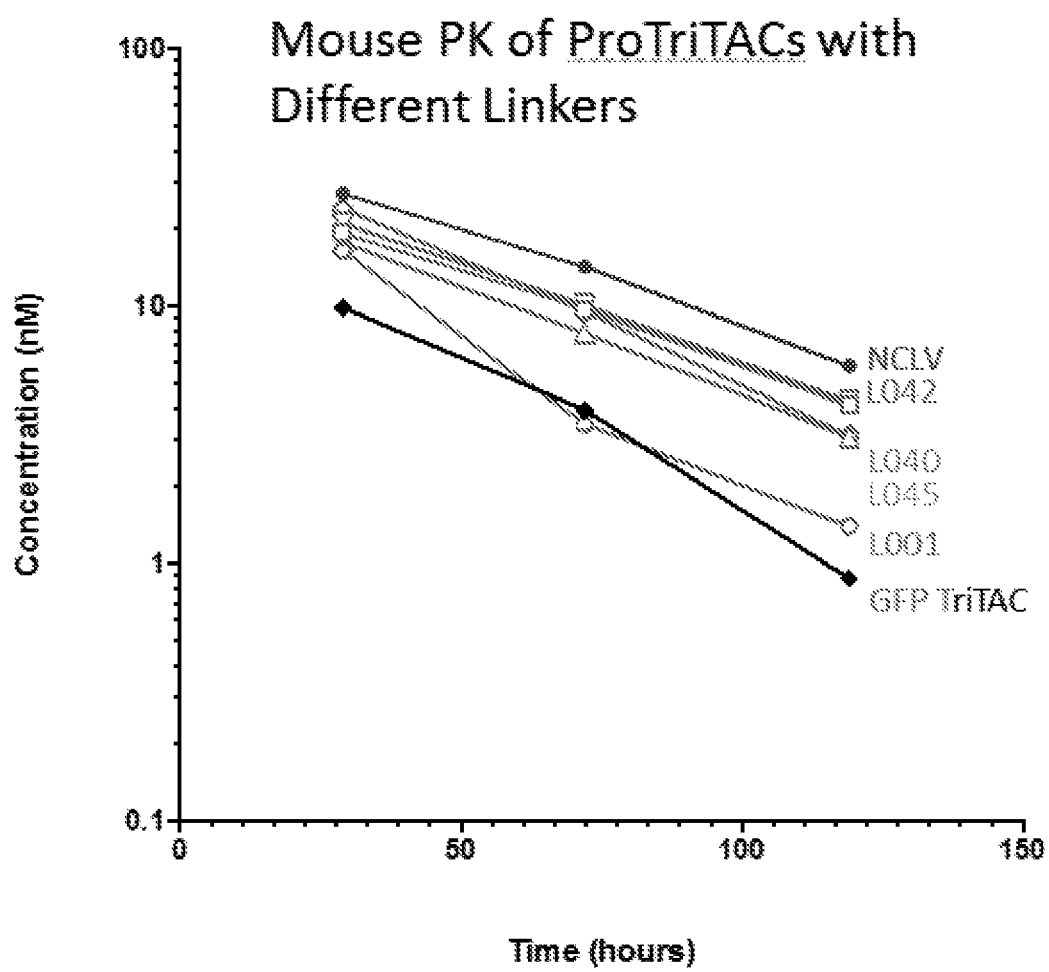
FIG. 19 shows pharmacokinetic profile of exemplary ProTriTAC molecules and TriTAC molecules of this disclosure.

The pharmacokinetics following administration of the various molecules, as described above, were also assessed and the data is shown in FIG. 19. The control GFP TriTAC molecule was rapidly cleared from circulation, following administration, whereas the NCLV molecule remained in circulation for the longest time. The pharmacokinetic clearance profile of the test ProTriTAC molecules were in between the GFP TriTAC and NCLV, except for the ProTriTAC containing the linker sequence L001, which was cleared almost as rapidly as the control GFP TriTAC.

Example 8: Individual Tumor Volumes of Admixed Xenograft Tumors, Following Treatment with Exemplary ProTriTAC Molecules Containing Various Exemplary Linkers The ProTriTAC molecules listed in Table 9, the control GFP TriTAC molecule, and the ProTriTAC NCLV molecule were evaluated in an admixed xenograft model, in order to determine the efficacy of the ProTriTAC molecules containing different linkers, in vivo. As described in previous example (Example 7), the xenograft tumor model was generated by injecting 7 week old NSG mice with 2.5×10$^6$ expanded human T cells, and 5×10$^6$ HCT116 (human colorectal carcinoma) tumor cells. The mice were divided into groups and each group was treated with at least one of the ProTriTAC molecules listed in Table 9, with the control GFP TriTAC molecule, or with the ProTriTAC NCLV molecule. Tumor volumes were measured at regular intervals, starting from day 10 post injection of tumor cells and expanded T cells.

It was observed that in animals treated with the exemplary ProTriTAC molecules containing linker L040 there was a statistically significant delay in tumor growth as compared to the mice group which was treated with the control GFP TriTAC molecule, or the mice group that was treated with the ProTriTAC NCLV molecule. Similar observation was also made for the ProTriTAC molecules containing linker sequences L001, L041, and L045. The data is shown in FIG. 20.

It is also possible to carry out a similar study with xenograft models using other cell lines, such as A549 (non-small cell lung carcinoma) cells, DU-145 (prostate) cells, MCF-7 (breast) cells, Colo 205 (colon) cells, 3T3/] GF-IR (mouse fibroblast) cells, NCI H441 cells, HEP G2 (hepatoma) cells, MDA MB 231 (breast) cells, HT-29 (colon) cells, MDA-MB-435s (breast) cells, U266 cells, SH-SYSY cells, Sk-Mel-2 cells, NCI-H929, RPM18226, and A431 cells.

Example 9: Demonstration of Reduced Cytokine Levels in Cynomolgus Monkeys, Correlated with Masking of TriTAC Molecules In this study, cynomolgus monkeys were treated with three different concentrations (30 µg/kg; 300 µg/kg; and 1000 µg/kg) of an exemplary EGFR targeting ProTriTAC molecule containing a non-cleavable linker (ProTriTAC (NCLV), or with three different concentrations (10 μg/kg; 30 μg/kg; and 100 μg/kg) of an exemplary EGFR targeting TriTAC molecule (SEQ ID No. 793).

Figures 21A, 21B, 21C:
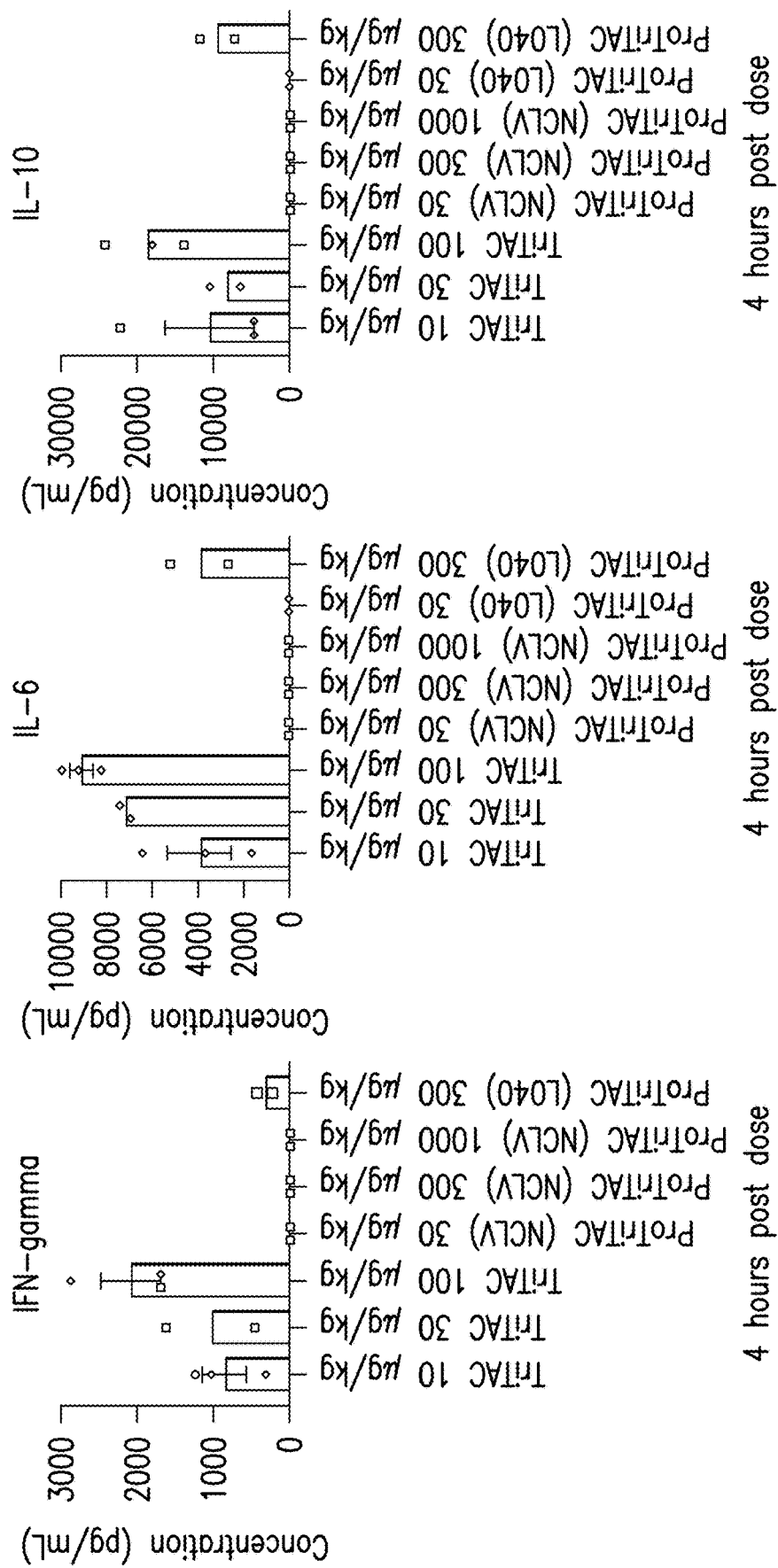
FIGS. 21A-21C shows cytokine levels (IFN-gamma (FIG. 21A), IL-6 (FIG. 21B), and IL-10.
Figure 24A:
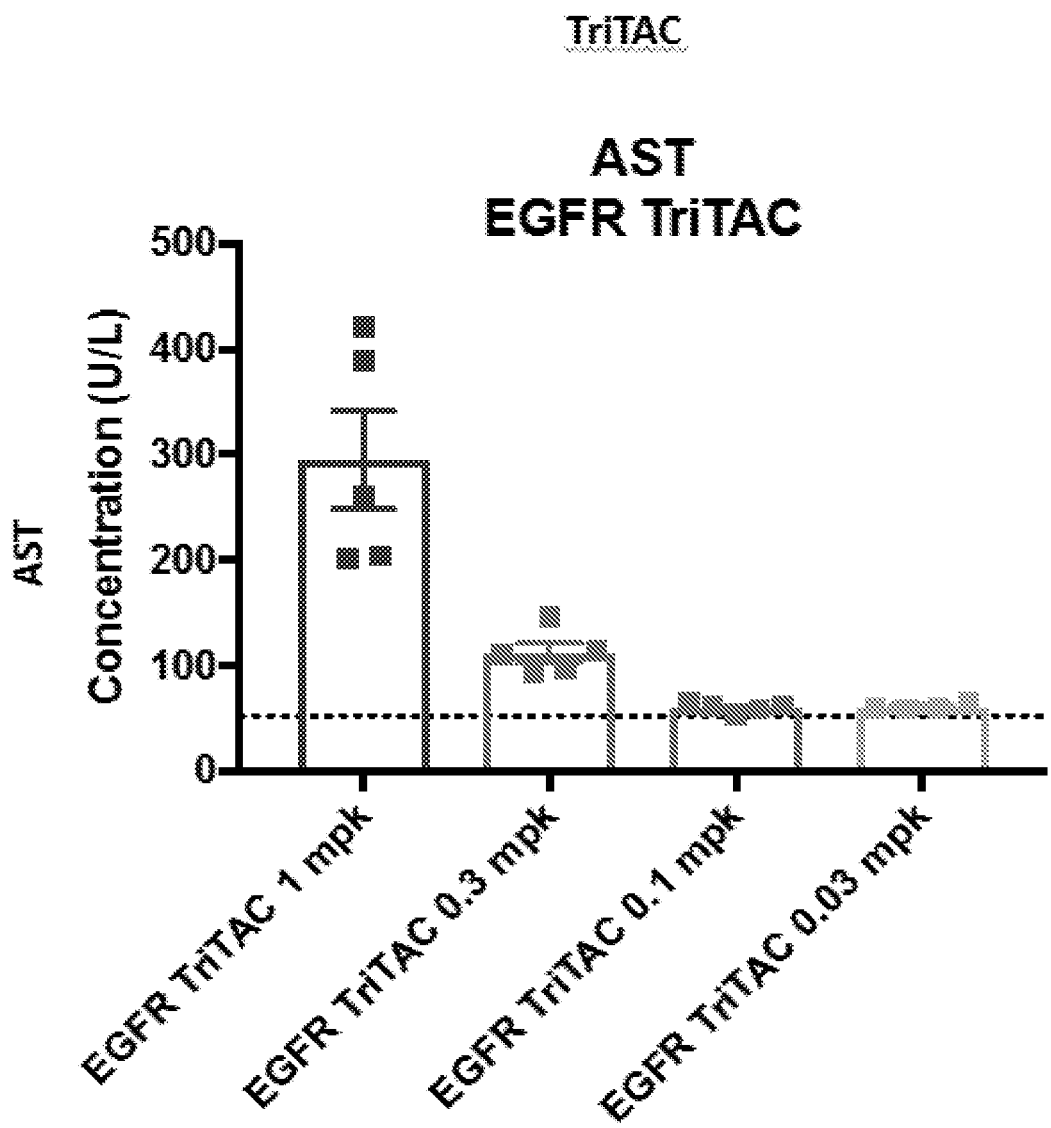
FIGS. 24A-24C show serum concentrations of aspartate aminotransferase (AST), in mice, following administering varying concentrations of a ProTriTAC molecule containing a non-cleavable linker (ProTriTAC (NCLV)) (FIG. 24C), a TriTAC molecule (FIG. 24A), or a ProtriTAC molecule (FIG. 24B) containing a cleavable linker.
Figure 24B:
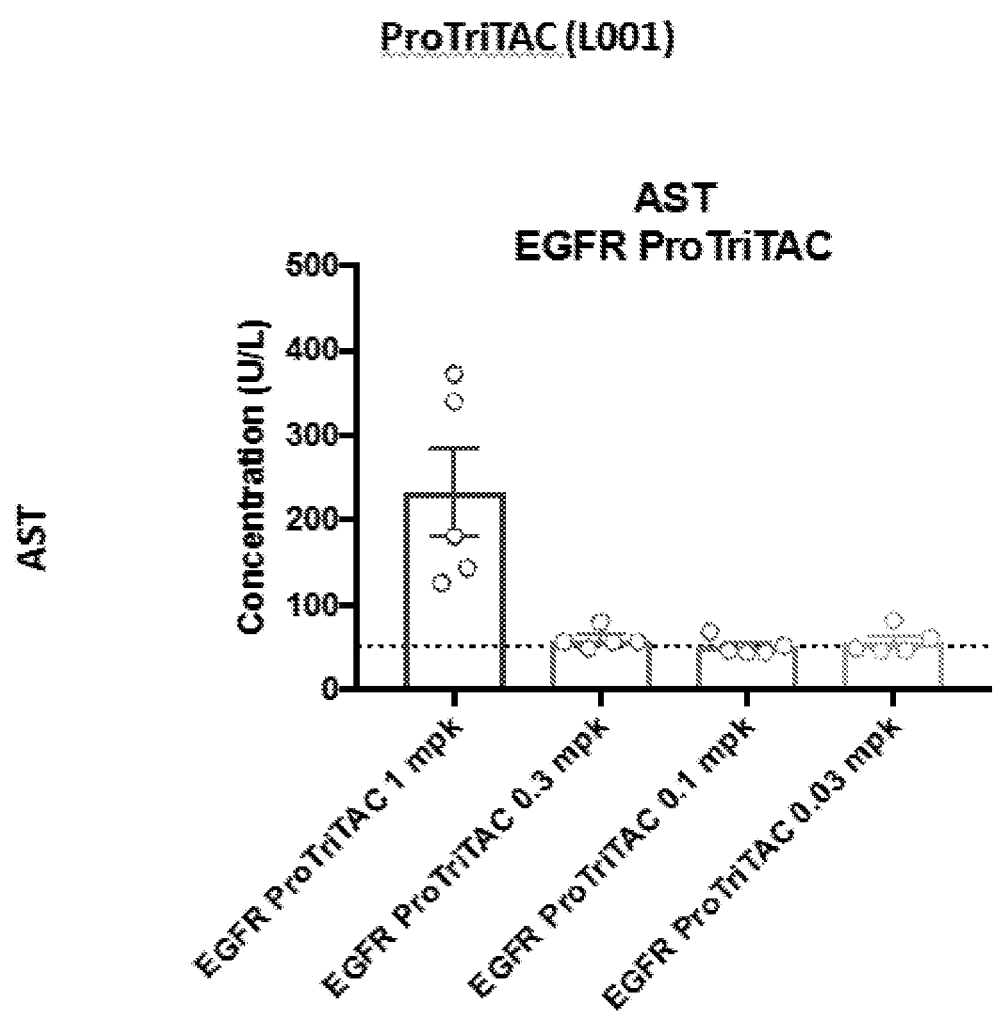
Figure 24C:
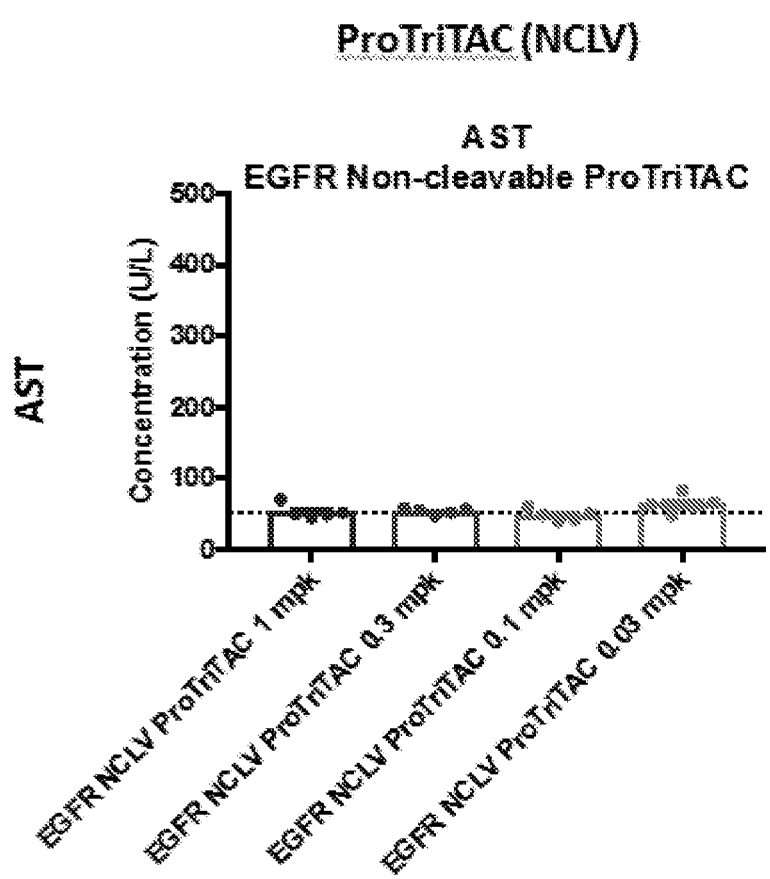
Figure 25A:
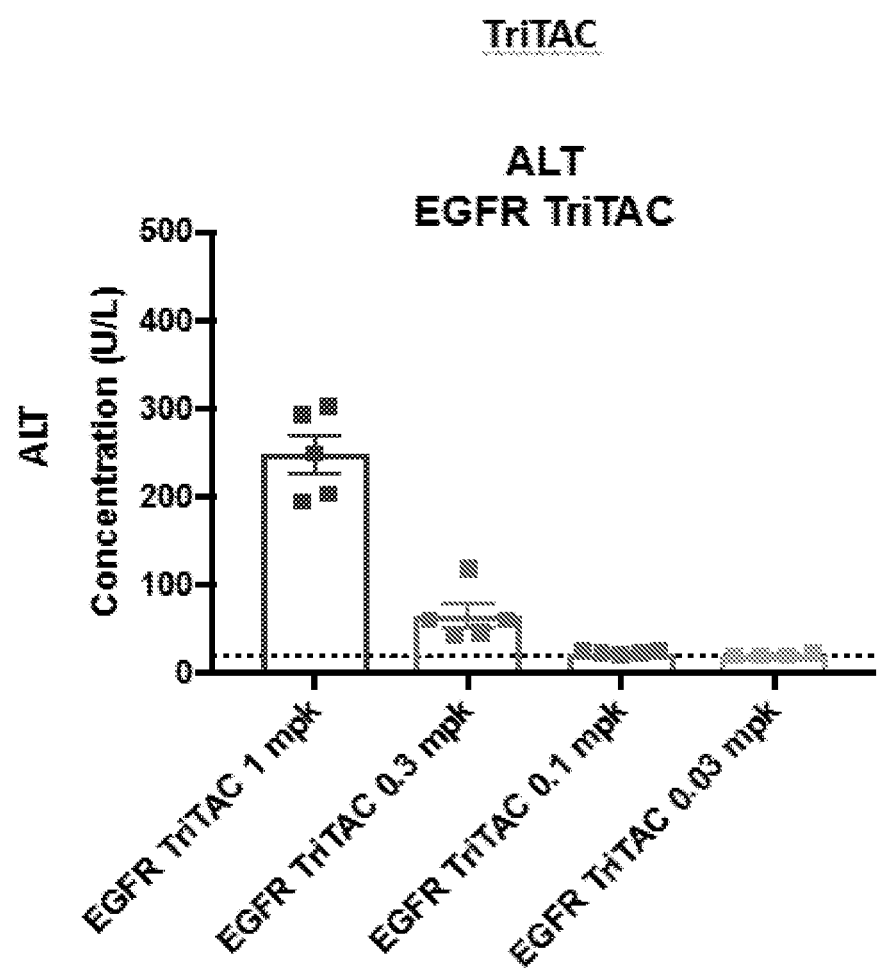
FIGS. 25A-25C show serum concentrations of alanine aminotransferase (ALT), in mice, following administering varying concentrations of a ProTriTAC molecule containing a non-cleavable linker (ProTriTAC (NCLV)) (FIG. 25C), a TriTAC molecule (FIG. 25A), or a ProtriTAC molecule (FIG. 25B) containing a cleavable linker.
Figure 25B:
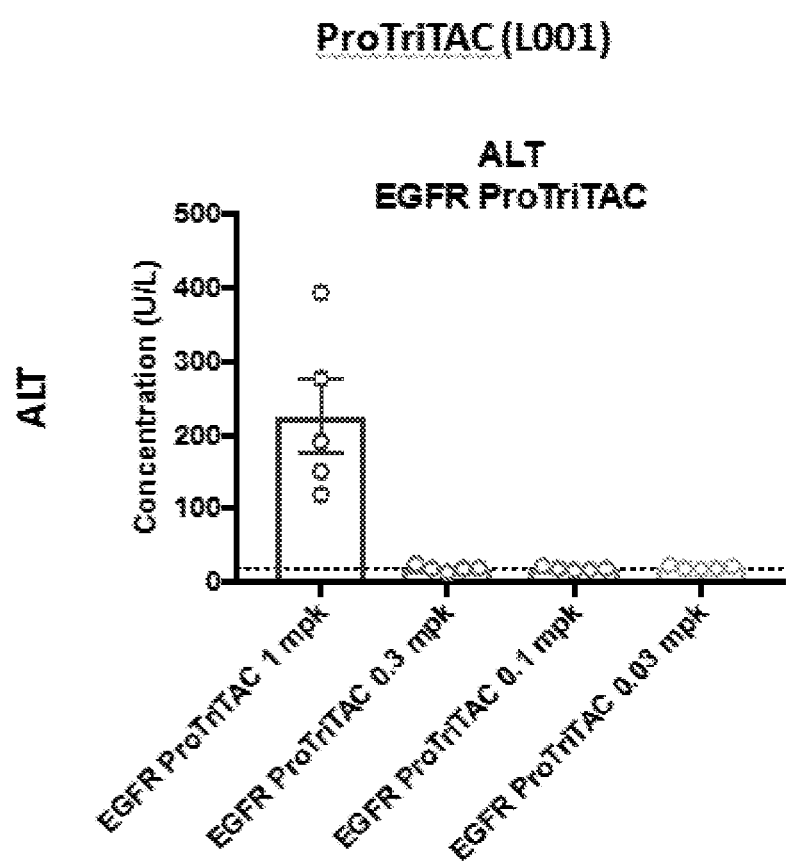
Figure 25C:
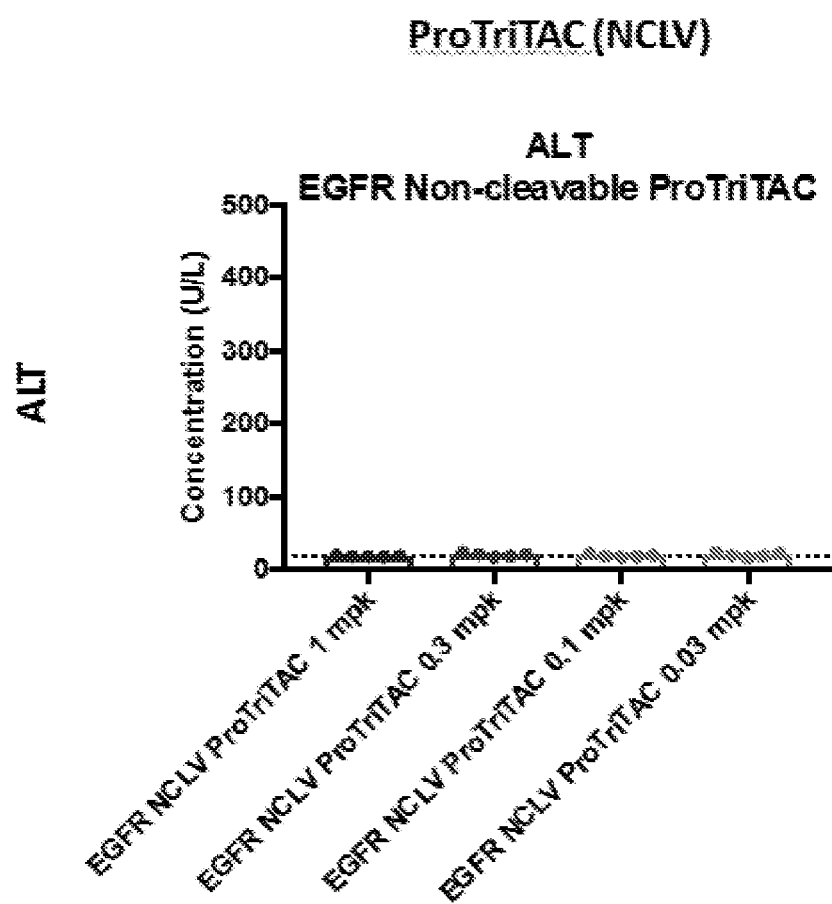

As shown in FIG. 21, after 4 hours following administering the ProTriTAC (NCLV) molecule, IFN-gamma IL-6 and IL-10 levels were significantly lower in comparison with administering the EGFR targeting TriTAC molecule.

Example 10: Demonstration of Improved Tolerability in Mouse, Conferred by an Exemplary EGFR Targeting ProTriTAC Molecule In this study, the tolerability of an exemplary EGFR targeting ProTriTAC molecule was assessed. Seven weeks old NSG female tumor free mice were intraperitoneally injected with 2×10$^7$ expanded human T cells at the commencement of the study, i.e., at day 0. On day 2, treatment was started by dividing the mice into various groups and administering to them varying concentrations of the exemplary EGFR targeting ProTriTAC molecule, containing the linker sequence L001, an EGFR targeting TriTAC molecule, and an EGFR targeting ProTriTAC molecule containing a non-cleavable linker (ProTriTAC (NCLV). The molecules were administered once daily for 10 days, at the following dosages: 30 μg/kg, 100 μg/kg, 300 μg/kg. Starting from day 2, body weight of the animals were recorded daily.

As shown in FIG. 22, the EGFR targeting ProTriTAC molecule containing a non-cleavable linker (ProTriTAC (NCLV)) and a GFP TriTAC (used as a negative control) were very well tolerated in mice even at the highest dose of 1000 μg/kg. The EGFR targeted ProTriTAC molecule containing the linker sequence of L001 was well tolerated at the dosage of 100 μg/kg, whereas the EGFR targeted TriTAC was well tolerated at 30 μg/kg. It was thus observed that the ProTriTAC containing the L001 linker sequence conferred about 3 fold increase in tolerability and the ProTriTAC (NCLV) conferred about a 30 fold increase in tolerability, in mouse. The mouse maximum tolerated dose for the ProTriTAC (NCLV) and TriTAC molecules was consistent with what was observed in cynomolgus monkeys.

To further explore the role of the linker in tolerability of the EGFR targeting ProTriTAC molecule in mouse, the linker sequence was changed from L001 to that of L040. In this experiment, seven weeks old NSG female tumor free mice were subcutaneously injected with 5×10$^6$HCT116 tumor cells, at the commencement of the study, i.e., at day 0. At day 7 following the tumor cell injection, when the tumor volumes were about 180-200 mm$^3$ (e.g., 183 mm$^3$), the mice were injected intraperitoneally with 2×10$^7$ expanded human T cells. Treatment was started on day 9, by dividing the mice into various groups and each group was administered an EGFR targeting TriTAC molecule, an EGFR targeting ProTriTAC molecule with linker sequence L040 (ProTriTAC(L040), and a ProTriTAC molecule containing a non-cleavable linker (ProTriTAC(NCLV). The molecules were administered once daily for 10 days, at the following dosages: 300 μg/kg and 1000 μg/kg. Starting from day 2, body weight of the animals were recorded daily. The results shown in FIG. 23 provide that the EGFR targeting ProTriTAC molecule with the linker sequence L040 conferred better tolerability than when the linker sequence L001 was used. The ProTriTAC (L040) was well-tolerated at 300 μg/kg and at 1000 μg/kg, with body weight percentage change comparable to that with the ProTriTAC (NCLV) molecule. It was thus observed that compared to the TriTAC molecule, the ProTriTAC containing the L040 linker sequence conferred about a 30 fold increase in tolerability, in mouse, similar to the 30 fold increase in tolerability observed with the ProTriTAC (NCLV) molecule.

Example 11: Clinical Pathology Studies in Mice and Cynomolgus Monkeys

In this study, mice were treated with various concentrations of an EFGR targeting TriTAC molecule, an EGFR targeting ProTriTAC molecule containing the linker sequence L001 (ProTriTAC (L001), and an EGFR targeting ProTriTAC molecule containing a non-cleavable linker (ProTriTAC(NCLV)). Tolerability was assessed by measuring serum concentration of ALT (alanine aminotransferase) and AST (aspartate aminotransferase). Results are shown in FIGS. 24A, 24B, and 24C and FIGS. 25A, 25B, and 25C. It was observed that serum concentrations of AST and ALT were not elevated following administering the ProTriTAC (L001) at dosages up to 0.3 mg/kg, and that the serum concentrations of AST and ALT were not elevated following administering the ProTriTAC(NCLV) at dosages up to 1 mg/kg. In contrast, serum concentration of AST and ALT were not elevated following administering the TriTAC molecule at a dosage of 0.3 mg/kg.

Figure 26:
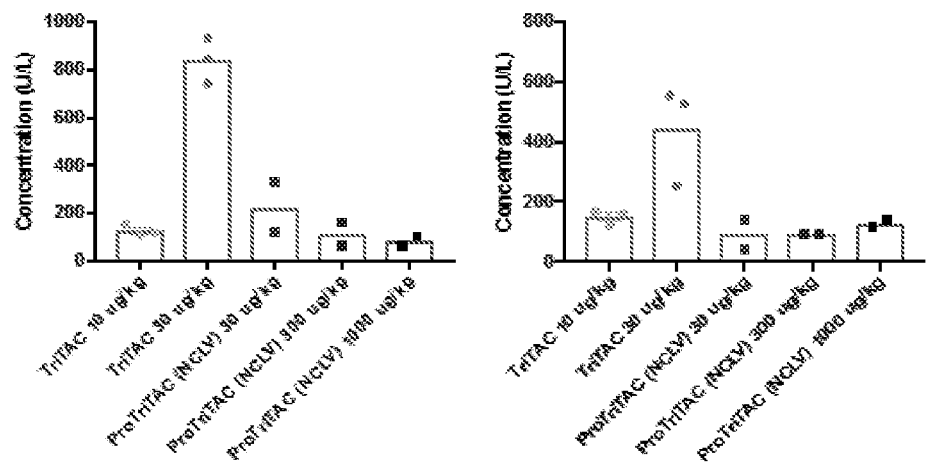
FIGS. 26A-26B show serum concentrations of ALT (right panel.

In another study, cynomolgus monkeys were treated with various concentrations of an EFGR targeting TriTAC molecule, and an EGFR targeting ProTriTAC molecule containing a non-cleavable linker (ProTriTAC(NCLV)). Tolerability was assessed by measuring serum concentration of ALT (alanine aminotransferase) and AST (aspartate aminotransferase). Results are shown in FIG. 26. It was observed that serum concentrations of AST and ALT were not elevated following administering the ProTriTAC (NCLV) at dosages up to 1000 μg/kg. In contrast, serum concentration of AST and ALT were not elevated following administering the TriTAC molecule at a dosage of 10 μg/kg.

Example 12: Demonstration of Therapeutic Window Expansion with an Exemplary ProTriTAC Molecule of this Disclosure in a Tumor-Bearing Mouse Model The aim of this study was to evaluate the expansion of therapeutic window by measuring anti-tumor activity and observable on-target toxicity in the same tumor-bearing mice. NSG female mice, 7 weeks old, were used for this study.

Figure 27A:
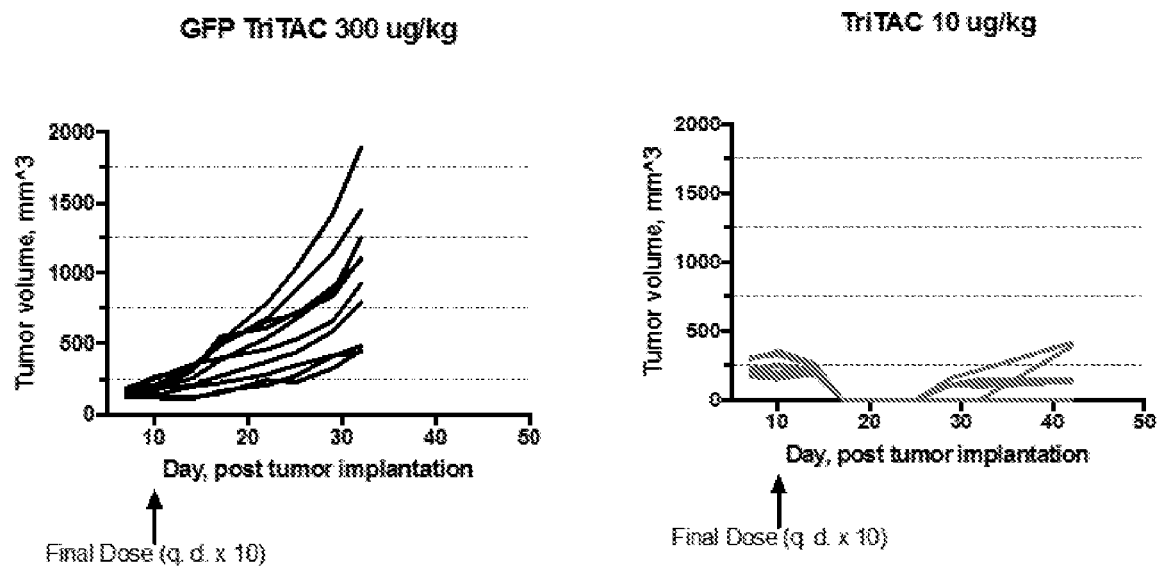
Figure 27B:
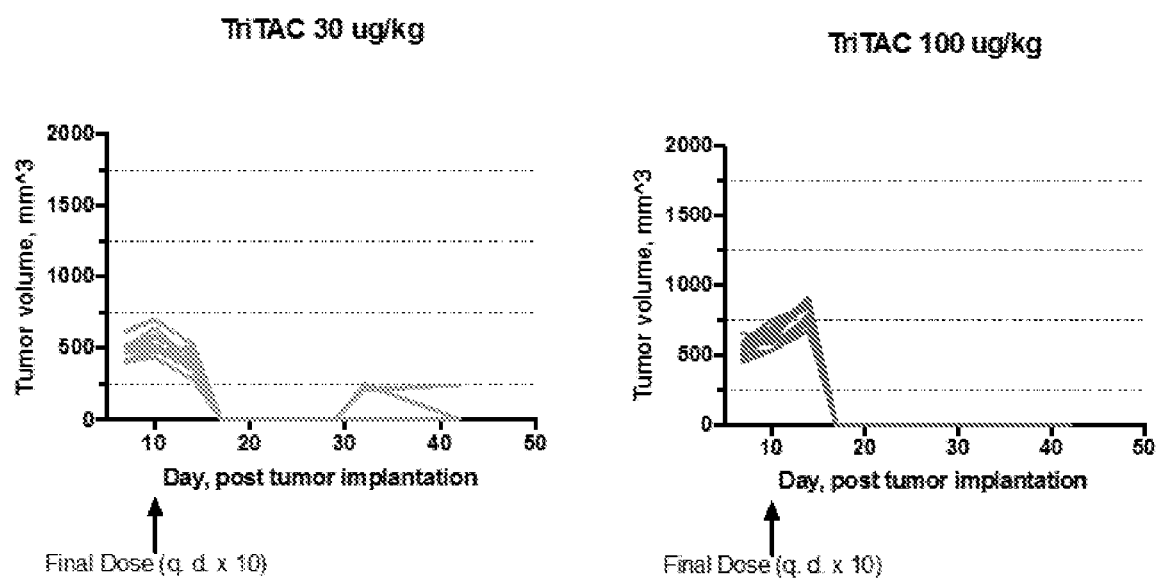

At the commencement of the study, on day 0, the NSG female mice were injected with 2.5×10$^6$ expanded human T cells, and 5×10$^6$ HCT116 (human colorectal carcinoma) tumor cells. The following day, on day 1, the mice were divided into groups and each group was treated with either GFP TriTAC molecule (SEQ ID No. 792), EGFR TriTAC molecule (SEQ ID No. 793), or an EGFR targeting ProTriTAC molecule containing linker L040, (SEQ ID No. 787) at the indicated dose levels in FIGS. 27A-297D (for GFP TriTAC the dosage was 300 μg/kg; for EGFR TriTAC dosages were 10 μg/kg, 30 μg/kg, 100 μg/kg, and 300 μg/kg; for EGFR ProTriTAC dosages were 30 μg/kg, 100 μg/kg, 300 μg/kg, and 1000 μg/kg) and administered daily for a period of 10 days (i.e., final dose was administered on day 10 following injection of tumor cells and expanded cells to the animals) and tumor volumes were measured at regular intervals, beginning a few days prior to the administration of the final dose at day 10. Results shown in FIGS. 27A-27D.

Figure 28:
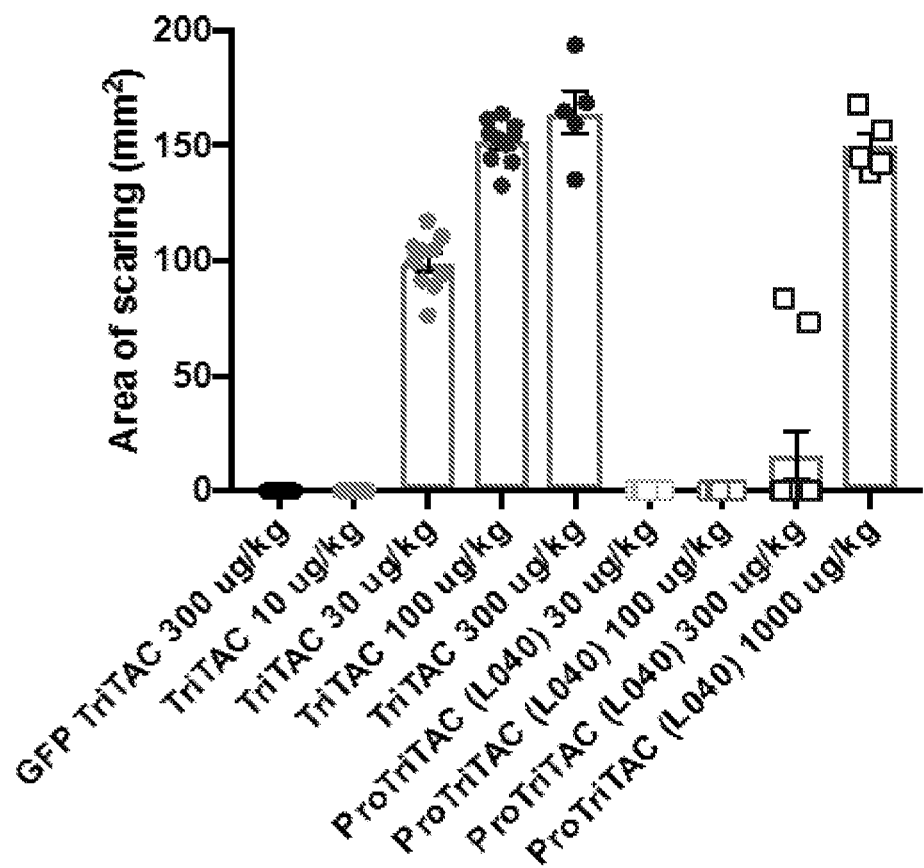
FIG. 28 shows serum concentrations of ALT and AST, in mice, following administration of varying concentrations of a GFP TriTAC, an EGFR TriTAC, and an EGFR ProTriTAC molecule.

On-target EGFR-related toxicity was determined by measuring the radius of the red scarring skin lesion above the original tumor implantation site with a caliper and applying the equation Area=π*(radius of lesion)² on day 14. Results provided in FIG. 28 show that an exemplary EGFR ProTriTAC has 30× better tolerability compared to an EGFR TriTAC in the same HCT116 tumor-bearing mice as measured by the onset of red scarring skin lesions above the original tumor implantation site. Therapeutic window is defined as the difference between the minimal dose level required for anti-tumor activity and the highest skin lesion-free dose level.

Results (from FIGS. 27 and 28) show that the exemplary protease-cleavable EGFR ProTriTAC is 3× less potent but 30× more tolerated (i.e., has a 10× improved therapeutic window) than the EGFR TriTAC when efficacy and toxicity are measured on the same tumor-bearing mice, as summarized in below Table. This would make it possible to dose the ProTriTAC at a dose that is about 3× higher than the TriTAC, to get at least the same efficiency and better tolerability.

|  | Min efficacious dose | Max scar-free dose | Therapeutic Window |
|---|---|---|---|
| TriTAC | 10 µg/kg | 10 µg/kg | 1 |
| ProTriTAC | 30 µg/kg | 300 µg/kg | 10 |

Example 13: An Exemplary ProTriTAC Molecule Containing a Binding Moiety with Extended Non-CDR Loop into which a Human CD3ε Epitope is Grafted The sequence of a binding moiety comprising non-CDR loops (AB, EF, C"D, and CC') was obtained. A portion of the human CD3ε sequence was grafted into the CC' loop of the non-CDR loops within the binding moiety, along with glycine residues to further extend the CC' loop. FIG. 29 illustrates three different variants comprising 10, 12, or 16 amino acid extensions to the CC' loop. In case of the variant CC10, the portion of human CD38 sequence grafted into the CC' loop, to replace the wild type sequence of APGKG (SEQ ID NO: 795) was QDGNEE (SEQ ID NO. 801), and in addition 4 glycine residues were inserted to extend the CC' loop. In case of the variant CC12, the portion of human CD3ε sequence grafted into the CC' loop, to replace the wild type sequence of APGKG (SEQ ID NO: 795) was QDGNEEMGG (SEQ ID No. 802), and in addition 3 glycine residues were inserted to extend the CC' loop. In case of the variant CC12, the portion of human CD3ε sequence grafted into the CC' loop, to replace the wild type sequence of APGKG (SEQ ID NO: 795) was QDGNEEMGG (SEQ ID No. 803), and in addition 7 glycine residues were inserted to extend the CC' loop. The binding moiety comprising extended non-CDR loops comprising the CD38 sequences, as described above, were cloned into a vector further comprising coding sequences for a protease cleavable linker, a scFv containing a CD3 binding domain, and an EGFR binding domain, to express a ProTriTAC molecule. The ProTriTAC molecule contained an exemplary binding moiety of this disclosure, a CD3 binding scFv, and an EGFR binding domain. The ProTriTAC molecule was subsequently exposed to a tumor associated protease, matriptase, to assay activation of the molecule upon cleavage of the protease cleavable linker, which separates the binding moiety (depicted as aALB in FIGS. 29 and 30) comprising the cleavable linker from the rest of the molecule, i.e., the scFv containing the CD3 binding domain (depicted as aCD3 in FIGS. 29 and 30) and the EGFR binding domain (aEGFR). FIG. 30 shows the activation of the ProTriTAC molecules, containing the CC10, CC12, or CC16 variants of CC' non-CDR loop, CD3 binding scFv in a VH-VL (left panel) or a VL-VH (right panel) format, upon treatment with matriptase. A ProTriTAC molecule containing a wild-type CC' loop in the binding moiety was used as a control for the protease activation assay. In addition, a TriTAC molecule that is not in the "pro" form, i.e., a molecule that includes the same domains as the ProTriTAC molecule, except that it has a half-life extension domain, such as albumin, instead of a binding moiety, was also treated with matriptase and used as a control. Results indicated that the ProTriTAC molecules were activated upon cleavage, to generate a free albumin binding domain (depicted as Free aALB in FIG. 30) whereas the albumin domain did not separate from the TriTAC molecules. Thus, the ProTriTAC molecules containing a binding moiety of this disclosure was able to readily dissociate from half-life extending domain upon cleavage in a tumor microenvironment, unlike the TriTAC versions, and thereby were amenable to rapid clearance from the systemic circulation upon activation.

Figure 31:
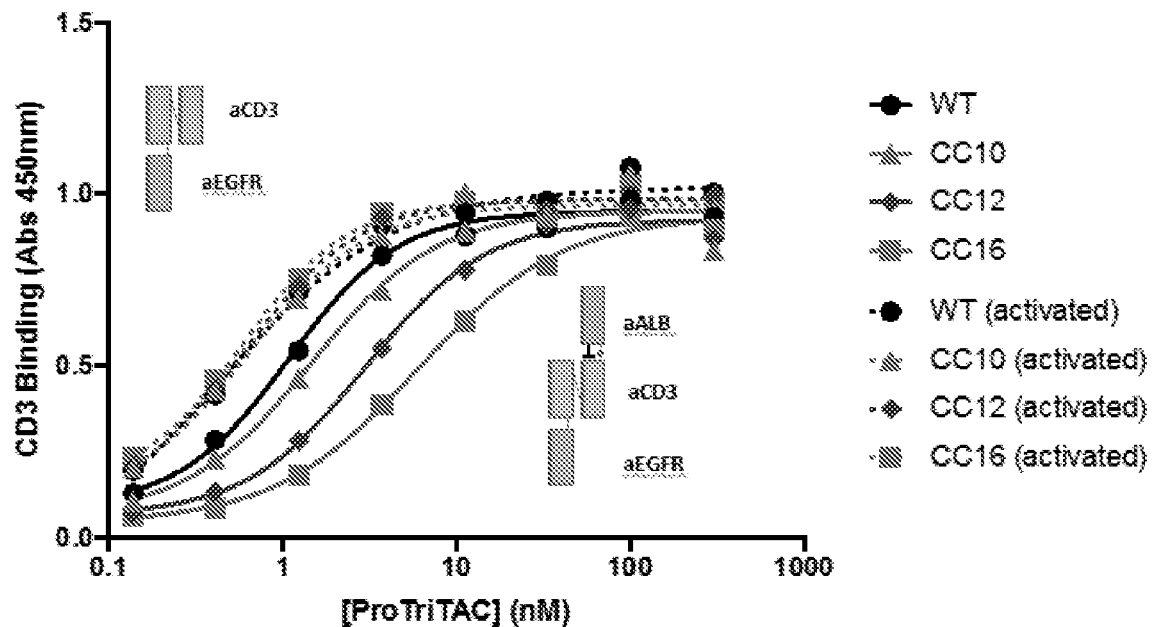
FIG. 31 shows CD3 binding of ProTriTAC molecules, with or without activation, containing an exemplary binding moiety of this disclosure.

Further studies were carried out to assay the binding of the binding moiety containing the human CD38 to CD3. It was observed that, in the presence of human serum albumin, the activated forms of ProTriTAC molecules that contained the binding moiety containing the human CD3ε were about 20 times potent in binding CD3 than their activated forms which did not contain the binding moiety. Results are shown in FIG. 31.

Figure 32:
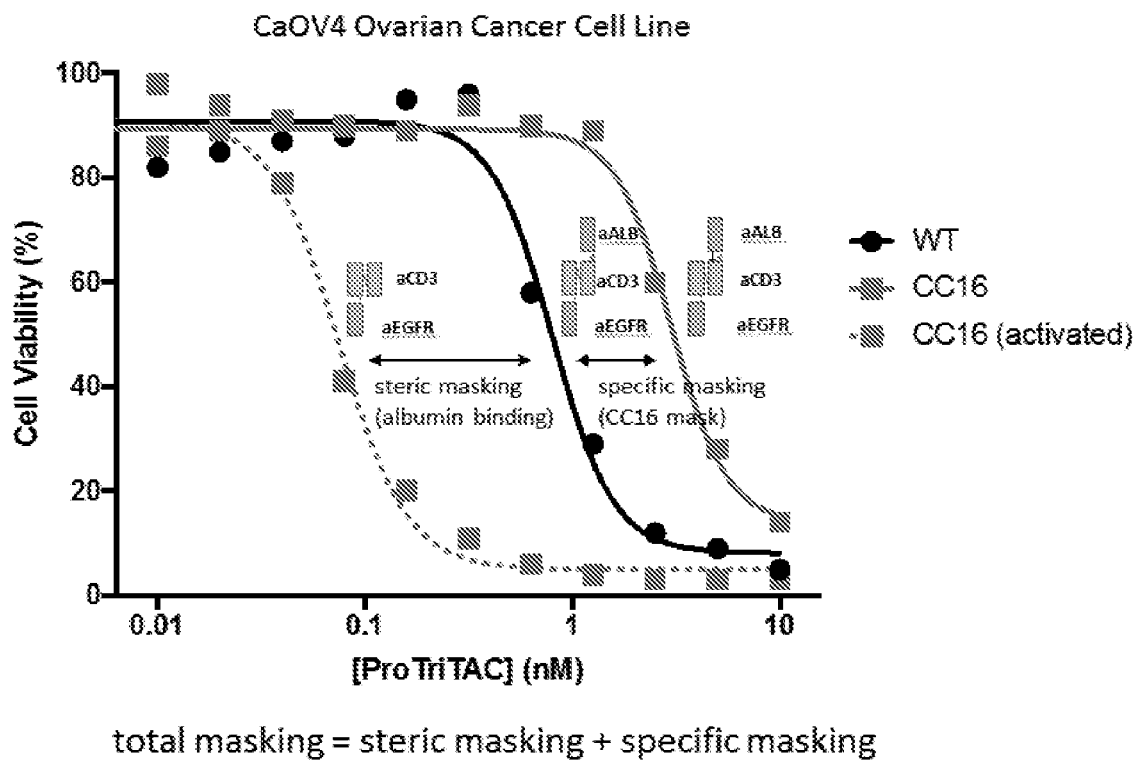
FIG. 32 shows cell killing potential of a ProTriTAC molecule, with or without activation, containing an exemplary binding moiety of this disclosure.

Cell killing potential of a ProTriTAC molecule that contained a binding moiety as described herein was also assayed in a study where CaOV4 cell line was treated with the ProTriTAC molecule or its activated form in the presence of human serum albumin. As shown in FIG. 32, the ProTriTAC molecule containing the CC16 variant of CC' non-CDR loop was about 50 times more potent in killing cancer cells compared to its activated form, which was separated from the albumin binding domain. The total observed masking is a combination of steric masking due to binding to human serum albumin and specific masking from the CC16 mask in the CC' non-CDR loop.

Example 14: Soft Library Mutagenesis Identified CC' Loop as Most Amenable to Modification To identify locations within the non-CDR loops (AB, CC', C"D, and EF) that were most amenable to modification, for creating a masking capability, libraries were assembled and generated using four groups of overlapping DNA oligos containing randomized degenerate "NNK" codons and with different loop lengths, as indicated in the schematic below:
  AB loop oligos:
  WT: LVQPGN (20%) (SEQ ID NO: 903)
  AB0: XXXXXX (20%)
  AB1: XXXXXXX (20%)
  AB2: XXXXXXXX (20%)
  AB3: XXXXXXXXX (20%)
  CC' loop oligos:
  WT: APGKG (20%) (SEQ ID NO: 795)
  CC0; XXXXX (20%)
  CC1: XXXXXX (20%)
  CC2: XXXXXXX (20%)
  CC3: XXXXXXXX (20%)
  C"D loop oligos:
  WT: DSVKGR (20%) (SEQ ID NO: 904)
  CD0: XXXXXX (20%)

CD1: XXXXXXX (20%)
CD2: XXXXXXXX (20%)
CD3: XXXXXXXXX (20%)
EF loop oligos:
WT: SLRPED (20%) (SEQ ID NO: 905)
EF0: XXXXXX (20%)
EF1: XXXXXXX (20%)
EF2: XXXXXXXX (20%)
EF3: XXXXXXXXX (20%)

Note: "X" denotes a randomized residue ("NNK" codon) that could be any of the 20 natural amino acids as well as stop codon. The goal was to have approximately 20% of each non-CDR loop be wild-type. These wild-type oligos served as internal benchmarks to gauge the tolerance of each loop to modification (sequence composition and/or length changes). A loop that was less tolerable to change could easily revert to wild-type; in contrast, a loop that was highly amenable to change would maintain the diverse sequence repertoire. To this end, 24 clones were sequenced from the naive library to verify the randomization of non-CDR loops prior to panning with HAS, as shown in FIG. 33. After two rounds of phage panning against HSA, 30 clones were sequenced to examine the non-CDR loop composition. The results showed that 3 out of 4 non-CDR loops (AB, C"D, and EF) mostly utilized the 20% wild-type oligo and reverted back to the wild-type, suggesting that they may be less preferred than the wild-type sequence. However, the CC' loop kept the diverse sequence repertoire (both sequence and length), suggesting that the CC' loop may be the loop most tolerable to randomization that we could exploit for specific masking of adjacent domains, as shown in FIG. 34.

Example 15: Screening of Phage Display Library for Identification of EpCAM Binding Domains Llamas were immunized with purified EpCAM protein expressed in Expi293 cells. A phage display library for expression of heavy variable antibody domains was constructed from circulating B cells. See van der Linden, de Geus, Stok, Bos, van Wassenaar, Verrips, and Frenken. 2000. J Immunol Methods 240:185-195. Phage clones were screened for binding to EpCAM by expressing anti-EpCAM proteins in E. coli, preparing periplasmic extracts, and proteins were screened for human and cynomolgus EpCAM binding activity using a colorimetric ELISA. Thirty-eight unique heavy chain only sequences were identified (SEQ ID Nos. 804-841) that produced a signal in the ELISA screening relative to the control with human and/or cynomolgus EpCAM proteins (as shown in Table 10).

TABLE 10

Binding of Llama anti-Human EpCAM heavy chain only single domain antibodies to Human and Cynomolgus EpCAM, as demonstrated by signal in an ELISA Assay (absorbance readings in a colorimetric ELISA assay), relative to control heavy chain only single domain antibodies

| Sequence name | ELISA Human EpCAM | ELISA Cynomolgus EpCAM | ELISA Control | Human EpCAM/ Control | Cynomolgus EpCAM/ Control |
|---|---|---|---|---|---|
| EPL90 | 1.6 | 1.7 | 0.2 | 10 | 10 |
| EPL118 | 3.4 | 2.9 | 0.7 | 5 | 4 |
| EPL138 | 3.1 | 2.7 | 0.9 | 3 | 3 |
| EPL145 | 0.6 | 0.4 | 0.2 | 3 | 2 |
| EPL164 | 0.6 | 2.8 | 0.1 | 7 | 34 |
| EPL31 | 0.6 | 0.5 | 0.1 | 7 | 6 |
| EPL55 | 0.4 | 0.6 | 0.1 | 5 | 7 |
| EPL57 | 1.7 | 3.4 | 0.1 | 14 | 27 |
| EPL136 | 0.9 | 1.3 | 0.1 | 9 | 13 |
| EPL15 | 0.7 | 3.2 | 0.1 | 8 | 35 |
| EPL34 | 0.9 | 3.1 | 0.1 | 10 | 36 |
| EPL86 | 0.8 | 3.0 | 0.1 | 8 | 31 |
| EPL153 | 3.1 | 2.2 | 0.1 | 31 | 21 |
| EPL20 | 2.9 | 2.2 | 0.5 | 6 | 4 |
| EPL70 | 3.2 | 2.2 | 0.1 | 24 | 16 |
| EPL125 | 3.5 | 3.5 | 0.5 | 8 | 8 |
| EPL13 | 2.9 | 4.0 | 0.2 | 17 | 23 |
| EPL129 | 2.0 | 3.1 | 0.1 | 20 | 29 |
| EPL159 | 0.4 | 0.2 | 0.1 | 3 | 2 |
| EPL120 | 3.2 | 2.3 | 0.6 | 5 | 4 |
| EPL126 | 3.4 | 2.8 | 0.7 | 5 | 4 |
| EPL60 | 1.1 | 3.5 | 0.1 | 10 | 33 |
| EPL156 | 3.6 | 4.0 | 0.2 | 16 | 17 |
| EPL2 | 2.2 | 3.6 | 0.1 | 15 | 24 |
| EPL43 | 1.8 | 3.8 | 0.1 | 13 | 27 |
| EPL10 | 2.7 | 2.0 | 0.2 | 12 | 9 |
| EPL49 | 1.1 | 0.6 | 0.1 | 8 | 4 |
| EPL58 | 1.1 | 0.5 | 0.1 | 8 | 4 |
| EPL74 | 1.4 | 0.7 | 0.1 | 10 | 5 |
| EPL78 | 3.1 | 2.0 | 0.2 | 17 | 11 |
| EPL82 | 0.9 | 1.1 | 0.2 | 4 | 5 |
| EPL83 | 2.0 | 1.1 | 0.6 | 3 | 2 |
| EPL97 | 2.5 | 1.7 | 0.3 | 8 | 5 |
| EPL109 | 0.4 | 0.1 | 0.1 | 5 | 2 |
| EPL117 | 0.9 | 0.6 | 0.2 | 4 | 3 |
| EPL127 | 0.4 | 0.9 | 0.1 | 5 | 11 |
| EPL152 | 3.4 | 2.8 | 0.8 | 4 | 4 |
| EPL189 | 1.3 | 0.9 | 0.1 | 12 | 8 |

Example 16: Incorporation of EpCAM Binding Heavy Chain Only Single Domain Antibodies into Fusion Proteins and T Cell Dependent Cellular Cytotoxicity Assays Selected anti-EpCAM heavy chain only single domain antibodies from Example 15 were cloned into DNA constructs for expression of recombinant proteins. These expression constructs all encoded a signal peptide. One set of anti-EpCAM constructs (SEQ ID Nos. 842 to 868) was designed to express a fusion protein with a humanized anti-CD3 scFv domain on the N-terminus of the mature secreted fusion protein followed by a llama anti-EpCAM domain, with the two domains linked by the sequence GGGGSGGGS (SEQ ID NO: 928), and with a HHHHHH (SEQ ID NO: 927) on the C-terminus. One second of anti-EpCAM constructs (SEQ ID Nos. 869 to 895) was designed to express a fusion protein with a llama anti-EpCAM domain on the N-terminus of the mature secreted fusion protein followed a humanized anti-CD3-scFv domain, with the two domains linked by the sequence GGGGSGGGS (SEQ ID NO: 928), and with a HHHHHH (SEQ ID NO: 927) on the C-terminus.

These anti-EpCAM/anti-CD3 (from N-terminus to C-terminus) or anti-CD3/anti-EpCAM (from N terminus to C terminus) fusion protein constructs were transfected into Expi293 cells. The amount of anti-EpCAM/anti-CD3 fusion protein in the conditioned media from the transfected Expi293 cells was quantitated using by using an Octet instrument with streptavidin and loaded with biotinylated CD3-Fc fusion protein using an anti-CD3 fusion protein of similar molecular weight to the anti-EPCAM/ant-CD3 proteins as a standard.

The conditioned media were tested in a T-cell dependent cellular cytotoxicity assay. See Nazarian A A, Archibeque I L, Nguyen Y H, Wang P, Sinclair A M, Powers D A. 2015. J Biomol Screen. 20:519-27. In this assay, luciferase labelled NCI-H508 cells, which express EpCAM, were combined with purified human T cells and a titration of the anti-EpCAM/anti-CD3 fusion protein or the anti-CD3/anti-Ep-CAM. It was hypothesized that if the fusion protein directs T cells to kill the NCI-H508 cells, the signal in a luciferase assay performed at 48 hours after starting the experiment should decrease. FIGS. 36-39 provide the TDCC data in graphical format. $EC_{50}$ values from the TDCC assays are listed in Table 11 (lists $EC_{50}$ data for SEQ ID Nos. 842 to 868) and Table 12 (lists $EC_{50}$ data for SEQ ID Nos. 869-895). The most potent molecule (EPL13) had an $EC_5$ value of about 1.6 pM. Some of the anti-EpCAM binding proteins were only active when present in an anti-CD3/anti-EpCAM configuration. One anti-EpCAM sequence, EPL34, was only active in the anti-EpCAM/anti-CD3 configuration. A negative control for the TDCC assays was anti-GFP/anti-CD3 protein, and this protein did not direct the T cells to kill the NCI-H508 cells (data not shown).

TABLE 11

$EC_{50}$ Values for Redirected T Cell Killing of NCI-H508 Cells by Anti-CD3/Anti-EPCAM Proteins Containing Llama Anti-EPCAM Sequences (n/a = insufficient activity to calculate an $EC_{50}$ using the protein concentrations tested)

| Anti-EpCAM Sequence | NCI-H508 Cell Killing $EC_{50}$ (M) |
|---|---|
| EPL10 | n/a |
| EPL109 | 2.2E-09 |
| EPL117 | n/a |
| EPL120 | 5.8e-010 |
| EPL125 | 1.3E-09 |
| EPL127 | n/a |
| EPL13 | 1.6E-12 |
| EPL136 | 6.1E-12 |
| EPL138 | 7.9E-12 |
| EPL145 | n/a |
| EPL152 | n/a |
| EPL153 | 1.4E-10 |
| EPL156 | n/a |
| EPL164 | 3.6E-10 |
| EPL189 | n/a |
| EPL2 | n/a |
| EPL20 | n/a |
| EPL34 | n/a |
| EPL49 | n/a |
| EPL58 | n/a |
| EPL74 | 2.6E-09 |
| EPL78 | n/a |
| EPL82 | n/a |
| EPL83 | 3.1E-10 |
| EPL86 | 4.7E-10 |
| EPL90 | 9.2E-12 |
| EPL97 | n/a |

TABLE 12

$EC_{50}$ Values for Redirected T Cell Killing of NCI-H508 Cells by Anti-EpCAM/Anti-CD3 Proteins Containing Llama Anti-EPpCAM Sequences (n/a = insufficient activity to calculate an $EC_{50}$ using the protein concentrations tested)

| Anti-EPCAM Sequence | NCI-H508 Cell Killing EC50 (M) |
|---|---|
| EPL10 | n/a |
| EPL109 | n/a |
| EPL117 | n/a |
| EPL120 | n/a |
| EPL125 | n/a |
| EPL127 | n/a |
| EPL13 | 1.6E-11 |
| EPL136 | 1.3E-10 |
| EPL138 | n/a |
| EPL145 | n/a |
| EPL152 | n/a |
| EPL153 | not expressed |
| EPL156 | n/a |
| EPL164 | n/a |
| EPL189 | n/a |
| EPL2 | n/a |
| EPL20 | n/a |
| EPL34 | 3.7E-10 |
| EPL49 | n/a |
| EPL58 | n/a |
| EPL74 | n/a |
| EPL78 | n/a |
| EPL82 | n/a |
| EPL83 | 2.1E-11 |
| EPL86 | 2.7E-10 |
| EPL90 | n/a |
| EPL97 | n/a |

Using conditioned media with known concentrations of anti-EpCAM/anti-CD3 or anti-CD3/anti-EpCAM fusion proteins, the binding affinities of the fusion proteins for human and cynomolgus monkey EpCAM proteins were measured. An Octet instrument with streptavidin tips were loaded with biotinylated human or cynomolgus EpCAM protein, and $K_D$ values were calculated by measuring the on rate and off rate of binding of the anti-EPCAM/anti-CD3 fusion or anti-CD3/anti-EpCAM fusion proteins to the biotinylated EpCAM proteins. The $K_D$ measurements were made using a single 50 nM concentration of the anti-EPCAM/anti-CD3 or anti-CD3/anti-EpCAM fusion proteins, which allowed for rank ordering potency. The measured relative affinities are listed in Table 13. All of the fusion proteins bound to cynomolgus EpCAM, with $K_D$ values ranging from 1.6 to 56 nM. Most, but not all of the fusion proteins were measured binding to human EpCAM with $K_D$ values ranging from 0.8 to 74 nM.

TABLE 13

Binding Affinities to Human and Cyno EpCAM of Anti-EPCAM/Anti-CD3 or Anti-CD3/Anti-EpCAM Fusion Proteins Containing Llama Anti-EpCAM Sequences

| | Anti-CD3/ Anti-EpCAM | | Anti-EpCAM/ Anti-CD3 | |
|---|---|---|---|---|
| Humanized anti-EpCAM Binder | hu KD (nM) | cy KD (nM) | hu KD (nM) | cy KD (nM) |
| EPL13 | 29 | 13 | 14 | 7.6 |
| EPL136 | 74 | 56 | 32 | 31 |
| EPL138 | 2.2 | 2.2 | 0.8 | 1.3 |
| EPL153 | n/q | 3.5 | No expression | |
| EPL164 | 3.1 | 3.6 | 2.1 | 2.9 |
| EPL34 | n/q | 14 | n/q | 6.4 |
| EPL83 | 1.1 | 3 | 1.6 | 3 |

TABLE 13-continued

Binding Affinities to Human and Cyno EpCAM
of Anti-EPCAM/Anti-CD3 or Anti-CD3/Anti-EpCAM
Fusion Proteins Containing Llama Anti-EpCAM Sequences

| Humanized anti-EpCAM Binder | Anti-CD3/Anti-EpCAM | | Anti-EpCAM/Anti-CD3 | |
|---|---|---|---|---|
| | hu KD (nM) | cy KD (nM) | hu KD (nM) | cy KD (nM) |
| EPL86 | n/q | 8.3 | n/q | 7 |
| EPL90 | 1.9 | 1.6 | 0.8 | 1.2 |

Example 17: Humanization of EpCAM Binding Heavy Chain Only Single Domain Antibodies and T Cell Dependent Cellular Cytotoxicity Assays Three of the llama anti-EpCAM antibodies sequences identified in Example 15 were humanized by grafting their CDR sequences onto human germline sequences, while retaining some llama framework sequences to ensure the antibodies did not lose activity (SEQ ID Nos. 896 to 898).

These sequences were cloned into expression constructs for expression of anti-EpCAM/anti-CD3 fusion proteins (SEQ ID Nos. 899 to 901) in Expi293 cells, as described in Example 16.

The amount of anti-EpCAM/anti-CD3 fusion proteins present in the conditioned medium was quantitated as described in Example 16. The affinities of these humanized proteins for human, cynomolgus, and mouse EpCAM were measured as described in Example 16. The relative $K_D$ values calculated from these measurements are listed in Table 14. All three sequences bound to human and cynomolgus EpCAM, with relative $K_D$ values ranging from about 0.3 to about 18 nM. Two of the sequences also bound to mouse EpCAM, with $K_D$ values ranging from about 1.4 to about 1.8 nM.

TABLE 14

Binding Affinities to Human, Cynomolgus, and Mouse EpCAM of Anti-EpCAM/Anti-CD3 Fusion Proteins Containing Llama Anti-EpCAM Sequences (n/q = not quantifiable under the experimental conditions used)

| Humanized Anti-EpCAM Sequence | Human EpCAM (nM) | Cynomolgus EpCAM (nM) | Mouse EPCAM (nM) |
|---|---|---|---|
| H13 | 17 | 18 | n/q |
| H90 | 0.3 | 1.3 | 1.4 |
| H138 | 0.3 | 1.8 | 1.8 |

Figure 40:
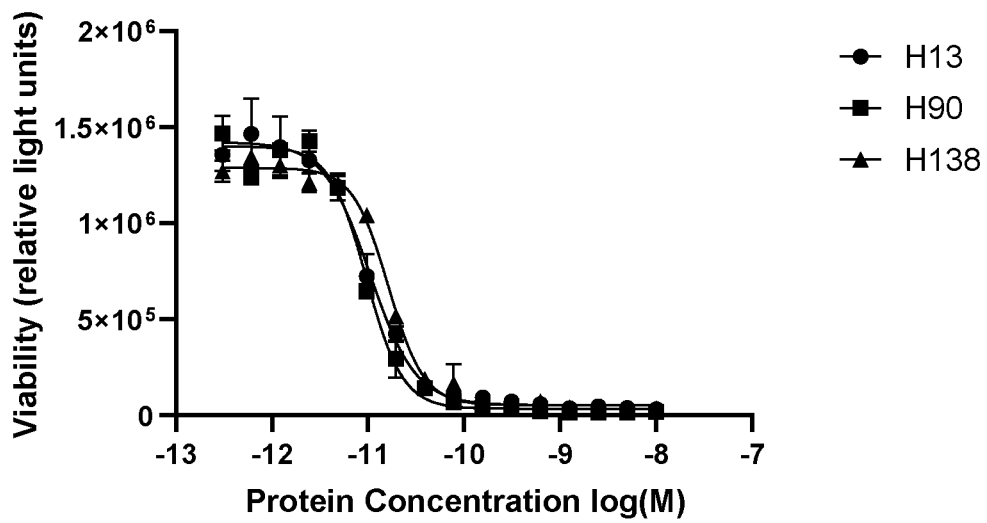
FIG. 40 provides results from a representative T cell dependency cellular cytotoxicity assay using exemplary fusion proteins of this disclosure containing a humanized anti-EpCAM domain as described herein and an anti-CD3 domain.

T cell killing potential of the anti-EpCAM/anti-CD3 fusion proteins present in the conditioned medium was assessed as described in Example 16. Results are provided in Table 15 and in FIG. 40.

TABLE 15

$EC_{50}$ Values for Redirected T Cell Killing of NCI-H508 Cells by Purified Anti-CD3/Anti-EpCAM Proteins Containing Humanized Anti-EpCAM Sequences

| Humanized anti-EpCAM Binder Sequence | $EC_{50}$ (pM) |
|---|---|
| H13 | 10 |
| H90 | 10 |
| H138 | 16 |

Example 18: Demonstration of Improved Tolerability in Mouse, Conferred by an Exemplary EpCAM Targeting ProTriTAC Molecule In this study, the tolerability of an exemplary EpCAM targeting ProTriTAC molecule was assessed. Seven weeks old NSG female tumor free mice were intraperitoneally injected with $2\times10^7$ expanded human T cells at the commencement of the study, i.e., at day 0. On day 2, treatment was started by dividing the mice into various groups and administering to them varying concentrations of the exemplary EpCAM targeting ProTriTAC molecule, containing the linker sequence L040, an EpCAMR targeting TriTAC molecule, an EpCAM targeting ProTriTAC molecule containing a non-cleavable linker (EpCAM ProTriTAC (NCLV), and a GFP TriTAC molecule (SEQ ID No. 792) as a control. The molecules were administered once daily for 10 days, at the following dosages: 0.03 mg/kg, 0.1 mg/kg, 0.3 mg/kg, and 1 mg/kg. Starting from day 2, body weight of the animals were recorded daily.

Figure 41A:
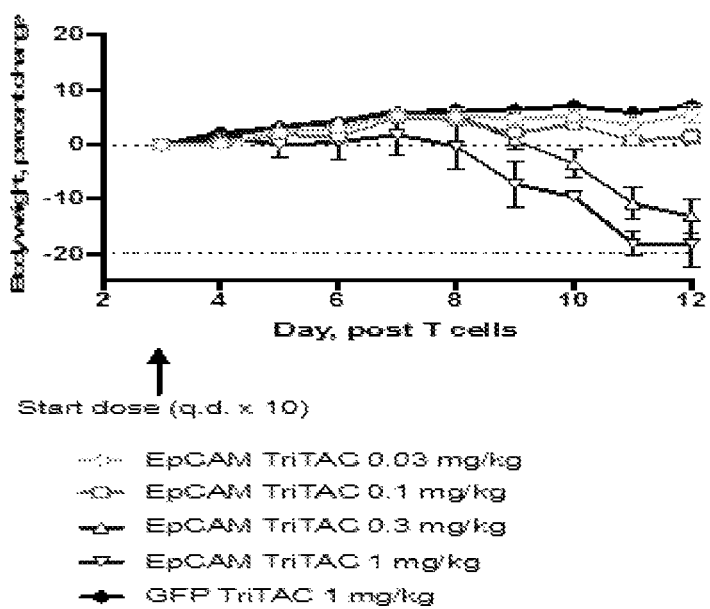
FIGS. 41A-41C show body weight percent change in mice, following administering exemplary EpCAM ProTriTAC molecules and EpCAM TriTAC molecules of this disclosure.
Figure 41B:
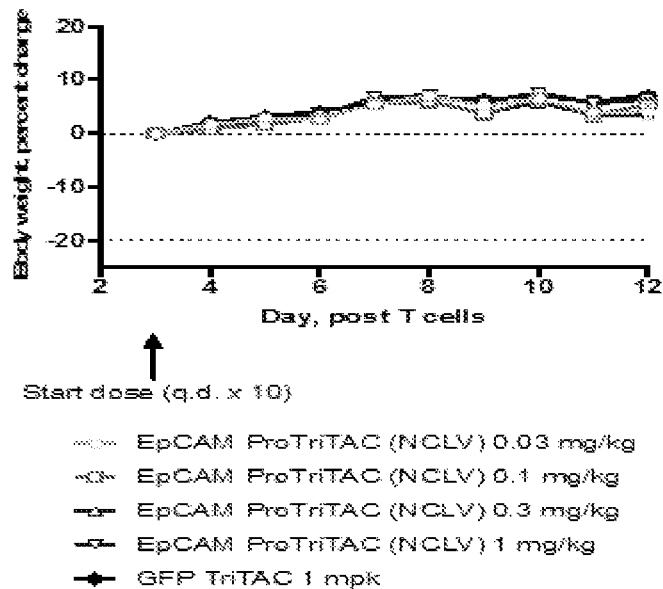
Figure 41C:
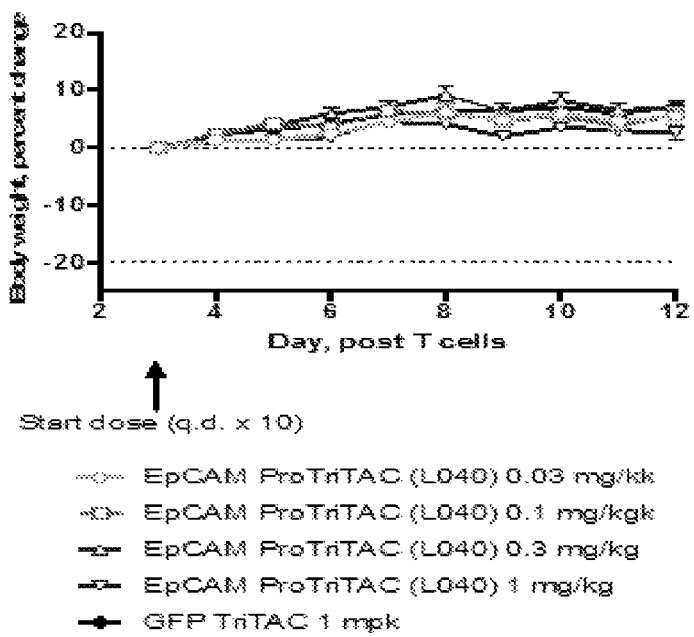

As shown in FIGS. 41A-41C, the EpCAM targeting ProTriTAC molecule containing a non-cleavable linker (ProTriTAC (NCLV)) (SEQ ID No. 908) and a GFP TriTAC (used as a negative control) were very well tolerated in mice even at the highest dose of 1 mg/kg. The EpCAM targeted ProTriTAC molecule containing the linker sequence of L040 (SEQ ID No. 907) was well tolerated at the highest tested dosage of 1 mg/kg, whereas the EpCAM targeted TriTAC (SEQ ID No. 906) was well tolerated 0.1 mg/kg. It was thus observed that the EpCAM targeting ProTriTAC containing the L040 linker sequence conferred at least about 10 times improved tolerability, in mouse, compared to the EpCAM targeting TriTAC.

Example 19: Xenograft Tumor Model

An EpCAM targeting fusion protein of this disclosure (e.g., a fusion protein which is a trispecific protein comprising an anti-EpCAM heavy chain only single domain antibody, an anti-CD3 scFv, and an anti-Albumin domain) is evaluated in a xenograft model. In order to determine efficacy of the exemplary EpCAM targeting fusion protein in vivo, multiple xenograft tumor models are used. Examples of common tumor cell lines for use in xenograft tumor studies include A549 (non-small cell lung carcinoma) cells, DU-145 (prostate) cells, MCF-7 (breast) cells, Colo 205 (colon) cells, 3T3 (mouse fibroblast) cells, NCI H441 cells, HEP G2 (hepatoma) cells, MDA MB 231 (breast) cells, HT-29 (colon) cells, MDA-MB-435s (breast) cells, U266 cells, SH-SYSY cells, Sk-Mel-2 cells, NCI-H929, RPM18226, and A431 cells. Immune-deficient NOD/scid mice are sub-lethally irradiated (2 Gy) and subcutaneously inoculated with $1\times10^6$ tumor cells (e.g., NCI H441 cells) into their right dorsal flank. When tumors reach 100 to 200 mm³, animals are allocated into 3 treatment groups. Groups 2 and 3 are intraperitoneally injected with $1.5\times10^7$ activated human T-cells. Three days later, animals from Group 3 are subsequently treated with the exemplary EPCAM targeting trispecific antigen-binding protein of Groups 1 and 2 are only treated with vehicle. Body weight and tumor volume are determined for 30 days, beginning at least 5 days post treatment with the exemplary EPCAM targeting trispecific protein.

It is expected that animals treated with the exemplary EpCAM targeting trispecific protein have a statistically significant delay in tumor growth in comparison to the respective vehicle-treated control group.

Example 20: Proof-of-Concept Clinical Trial Protocol for Administration of the EpCAM Targeting Trispecific Antigen-Binding Protein of Example 19 to Ovarian Cancer Patients This is a Phase I/II clinical trial for studying an exemplary EpCAM targeting trispecific antigen-binding protein of this disclosure as a treatment for an epithelial ovarian cancer.
1. Study Outcomes:
2. Primary: Maximum tolerated dose of the exemplary EpCAM targeting trispecific protein.
3. Secondary: To determine whether in vitro response of the exemplary EpCAM targeting trispecific protein is associated with clinical response Phase I
4. The maximum tolerated dose (MTD) will be determined in the phase I section of the trial.
1.1 The maximum tolerated dose (MTD) will be determined in the phase I section of the trial.
1.2 Patients who fulfill eligibility criteria will be entered into the trial to EPCAM targeting trispecific proteins of the previous examples.
1.3 The goal is to identify the highest dose of EpCAM targeting trispecific proteins of the previous examples that can be administered safely without severe or unmanageable side effects in participants. The dose given will depend on the number of participants who have been enrolled in the study prior and how well the dose was tolerated. Not all participants will receive the same dose.

Phase II
2.1 A subsequent phase II section will be treated at the MTD with a goal of determining if therapy with therapy of the exemplary EpCAM targeting trispecific protein results in at least a 20% response rate.
Primary Outcome for the Phase II—To determine if therapy of EPCAM targeting trispecific protein results in at least 20% of patients achieving a clinical response (blast response, minor response, partial response, or complete response)
Eligibility:
   Histologically or cytologically confirmed epithelial ovarian cancer. May have Recurrent epithelial ovarian carcinoma or disease progression following failure of first-line, platinum-based chemotherapy with no more than one prior platinum based regimen therapy
   Adequate laboratory values of bone marrow function, renal function, liver function, and echocardiogram tests Phase III
5.3.1A subsequent phase III section will carried out with the exemplary EpCAM targeting trispecific protein, wherein secondary endpoints such as response rate (RR), patient recorded outcomes (PRO), progression-free survival (PFS), duration of progression free survival, time to progression (TIP), overall survival, health-related quality of life assessment, number of participants with overall survival, duration of response, time to response, number of participants with response, and time to tumor growth etc. will be assessed.

| SEQUENCE TABLE | |
|---|---|
| DESCRIPTION | SEQUENCE |
| PSMA Prodrug C1872 (SEQ ID NO: 43) | EVQLVESGGGLVQPGNSLRLSCAASGFTFSKFGMSWVRQGGG<br>GGLDGNEEPGGLEWVSSISGSGRDTLYADSVKGRFTISRDNAK<br>TTLYLQMNSLRPEDTAVYYCTIGGSLSVSSQGTLVTVSSGGGGK<br>PLGLQARVVGGGGT<br>QTVVTQEPSLTVSPGGTVTLTCASSTGAVTSGNYPNWVQQKP<br>GQAPRGLIGGTKFLVPGTPARFSGSLLGGKAALTLSGVQPEDEA<br>EYYCTLWYSNRWVFGGGTKLTVLGGGGSGGGGSGGGGSEVQ<br>LVESGGGLVQPGGSLKLSCAASGFTFNKYAINWVRQAPGKGLE<br>WVARIRSKYNNYATYYADQVKDRFTISRDDSKNTAYLQMNNL<br>KTEDTAVYYCVRHANFGNSYISYWAYWGQGTLVTVSSGGGGS<br>GGGSEVQLVESGGGLVQPGGSLTLSCAASRFMISEYHMHWVR<br>QAPGKGLEWVSTINPAGTTDYAESVKGRFTISRDNAKNTLYLQ<br>MNSLKPEDTAVYYCDSYGYRGQGTQVTVSSHHHHHH |
| PSMA Non-cleavable Prodrug C1873 (SEQ ID NO: 44) | EVQLVESGGGLVQPGNSLRLSCAASGFTFSKFGMSWVRQGGG<br>GGLDGNEEPGGLEWVSSISGSGRDTLYADSVKGRFTISRDNAK<br>TTLYLQMNSLRPEDTAVYYCTIGGSLSVSSQGTLVTVSSGGGGS<br>GGGGSGGVVGGGGT<br>QTVVTQEPSLTVSPGGTVTLTCASSTGAVTSGNYPNWVQQKP<br>GQAPRGLIGGTKFLVPGTPARFSGSLLGGKAALTLSGVQPEDEA<br>EYYCTLWYSNRWVFGGGTKLTVLGGGGSGGGGSGGGGSEVQ<br>LVESGGGLVQPGGSLKLSCAASGFTFNKYAINWVRQAPGKGLE<br>WVARIRSKYNNYATYYADQVKDRFTISRDDSKNTAYLQMNNL<br>KTEDTAVYYCVRHANFGNSYISYWAYWGQGTLVTVSSGGGGS<br>GGGSEVQLVESGGGLVQPGGSLTLSCAASRFMISEYHMHWVR<br>QAPGKGLEWVSTINPAGTTDYAESVKGRFTISRDNAKNTLYLQ<br>MNSLKPEDTAVYYCDSYGYRGQGTQVTVSSHHHHHH |
| PSMA Active Drug C1875 (SEQ ID NO: 45) | VVGGGGTQTVVTQEPSLTVSPGGTVTLTCASSTGAVTSGNYP<br>NWVQQKPGQAPRGLIGGTKFLVPGTPARFSGSLLGGKAALTLS<br>GVQPEDEAEYYCTLWYSNRWVFGGGTKLTVLGGGGSGGGGS<br>GGGGSEVQLVESGGGLVQPGGSLKLSCAASGFTFNKYAINWV<br>RQAPGKGLEWVARIRSKYNNYATYYADQVKDRFTISRDDSKNT<br>AYLQMNNLKTEDTAVYYCVRHANFGNSYISYWAYWGQGTLV<br>TVSSGGGGSGGGGSEVQLVESGGGLVQPGGSLTLSCAASRFMIS<br>EYHMHWVRQAPGKGLEWVSTINPAGTTDYAESVKGRFTISRD<br>NAKNTLYLQMNSLKPEDTAVYYCDSYGYRGQGTQVTVSSHHH<br>HHH |

SEQUENCE TABLE

| DESCRIPTION | SEQUENCE |
| --- | --- |
| EGFR (G8) Prodrug C1486 (SEQ ID NO: 46) | EVQLVESGGGLVQPGNSLRLSCAASGFTFSKFGMSWVRQGGG GGLDGNEEPGGLEWVSSISGSGRDTLYADSVKGRFTISRDNAK TTLYLQMNSLRPEDTAVYYCTIGGSLSVSSQGTLVTVSSGGGGK PLGLQARVVGGGGT QTVVTQEPSLTVSPGGTVTLTCASSTGAVTSGNYPNWVQQKP GQAPRGLIGGTKFLVPGTPARFSGSLLGGKAALTLSGVQPEDEA EYYCTLWYSNRWVFGGGTKLTVLGGGGSGGGGSGGGGSEVQ LVESGGGLVQPGGSLKLSCAASGFTFNKYAINWVRQAPGKGLE WVARIRSKYNNYATYYADQVKDRFTISRDDSKNTAYLQMNNL KTEDTAVYYCVRHANFGNSYISYWAYWGQGTLVTVSSGGGGS GGGSEVQLVESGGGLVQPGGSLTLSCAASGRTFSSYAMGWFR QAPGKEREFVVAINWASGSTYYADSVKGRFTISRDNSKNTLYL QMNSLRAEDTAVYYCAAGYQINSGNYNFKDYEYDYWGQGTL VTVSSHHHHHH |
| EGFR (G8) Non-cleavable Prodrug C1756 (SEQ ID NO: 47) | EVQLVESGGGLVQPGNSLRLSCAASGFTFSKFGMSWVRQGGG GGLDGNEEPGGLEWVSSISGSGRDTLYADSVKGRFTISRDNAK TTLYLQMNSLRPEDTAVYYCTIGGSLSVSSQGTLVTVSSGGGGS GGGGSGGVVGGGGT QTVVTQEPSLTVSPGGTVTLTCASSTGAVTSGNYPNWVQQKP GQAPRGLIGGTKFLVPGTPARFSGSLLGGKAALTLSGVQPEDEA EYYCTLWYSNRWVFGGGTKLTVLGGGGSGGGGSGGGGSEVQ LVESGGGLVQPGGSLKLSCAASGFTFNKYAINWVRQAPGKGLE WVARIRSKYNNYATYYADQVKDRFTISRDDSKNTAYLQMNNL KTEDTAVYYCVRHANFGNSYISYWAYWGQGTLVTVSSGGGGS GGGSEVQLVESGGGLVQPGGSLTLSCAASGRTFSSYAMGWFR QAPGKEREFVVAINWASGSTYYADSVKGRFTISRDNSKNTLYL QMNSLRAEDTAVYYCAAGYQINSGNYNFKDYEYDYWGQGTL VTVSSHHHHHH |
| EGFR (G8) Active Drug C1300 (SEQ ID NO: 48) | VVGGGGTQTVVTQEPSLTVSPGGTVTLTCASSTGAVTSGNYP NWVQQKPGQAPRGLIGGTKFLVPGTPARFSGSLLGGKAALTLS GVQPEDEAEYYCTLWYSNRWVFGGGTKLTVLGGGGSGGGGS GGGGSEVQLVESGGGLVQPGGSLKLSCAASGFTFNKYAINWV RQAPGKGLEWVARIRSKYNNYATYYADQVKDRFTISRDDSKNT AYLQMNNLKTEDTAVYYCVRHANFGNSYISYWAYWGQGTLV TVSSGGGGSGGGGSEVQLVESGGGLVQPGGSLTLSCAASGRTFS SYAMGWFRQAPGKEREFVVAINWASGSTYYADSVKGRFTISR DNSKNTLYLQMNSLRAEDTAVYYCAAGYQINSGNYNFKDYEY DYWGQGTLVTVSSHHHHHH |
| GFP TriTAC C646 (SEQ ID NO: 49) | QVQLVESGGALVQPGGSLRLSCAASGFPVNRYSMRWYRQAP GKEREWVAGMSSAGDRSSYEDSVKGRFTISRDDARNTVYLQM NSLKPEDTAVYYCNVNVGFEYWGQGTQVTVSSGGGGSGGGG EVQLVESGGGLVQPGNSLRLSCAASGFTFSKFGMSWVRQAPG KGLEWVSSISGSGRDTLYADSVKGRFTISRDNAKTTLYLQMNSL RPEDTAVYYCTIGGSLSVSSQGTLVTVSSGGGGSGGGGSEVQLVE SGGGLVQPGGSLKLSCAASGFTFNKYAINWVRQAPGKGLEWV ARIRSKYNNYATYYADQVKDRFTISRDDSKNTAYLQMNNLKTE DTAVYYCVRHANFGNSYISYWAYWGQGTLVTVSSGGGGSGG GGSGGGGSQTVVTQEPSLTVSPGGTVTLTCASSTGAVTSGNYP NWVQQKPGQAPRGLIGGTKFLVPGTPARFSGSLLGGKAALTLS GVQPEDEAEYYCTLWYSNRWVFGGGTKLTVLHHHHHH |
| Exemplary masking sequence (SEQ ID NO: 50) | GGGGGLDGNEEPGG |
| Exemplary non-cleavable linker sequence comprising protease cleavage site (SEQ ID NO: 51) | GGGGSGGGGSGGVVGGGGT |
| PSMA Non-masked Non-cleavable Prodrug C1874 (SEQ ID NO: 52) | EVQLVESGGGLVQPGNSLRLSCAASGFTFSKFGMSWVRQAPG KGLEWVSSISGSGRDTLYADSVKGRFTISRDNAKTTLYLQMNSL RPEDTAVYYCTIGGSLSVSSQGTLVTVSSGGGGSGGGGSGGVV GGGGTQTVVTQEPSLTVSPGGTVTLTCASSTGAVTSGNYPNW VQQKPGQAPRGLIGGTKFLVPGTPARFSGSLLGGKAALTLSGV QPEDEAEYYCTLWYSNRWVFGGGTKLTVLGGGGSGGGGSGG GGSEVQLVESGGGLVQPGGSLKLSCAASGFTFNKYAINWVRQ APGKGLEWVARIRSKYNNYATYYADQVKDRFTISRDDSKNTAY LQMNNLKTEDTAVYYCVRHANFGNSYISYWAYWGQGTLVTV SSGGGGSGGGSEVQLVESGGGLVQPGGSLTLSCAASRFMISEY HMHWVRQAPGKGLEWVSTINPAGTTDYAESVKGRFTISRDN AKNTLYLQMNSLKPEDTAVYYCDSYGYRGQGTQVTVSSHHHH HH |

SEQUENCE TABLE

| DESCRIPTION | SEQUENCE |
| --- | --- |
| Exemplary cleavable linker (SEQ ID NO: 53) | GGGGKPLGLQARVVGGGGT |
| Exemplary anti-albumin sdAb (SEQ ID NO: 54) | EVQLVESGGGLVQPGNSLRLSCAASGFTFSKFGMSWVRQGGGGGLDGNEEPGGLEWVSSISGSGRDTLYADSVKGRFTISRDNAK TTLYLQMNSLRPEDTAVYYCTIGGSLSVSSQGTLVTVSSGGGGKPLGLQARVVGGGGT |
| Exemplary anti-target (anti-EGFR) sdAb (SEQ ID NO: 55) | EVQLVESGGGLVQPGGSLTLSCAASGRTFSSYAMGWFRQAPG KEREFVVAINWASGSTYYADSVKGRFTISRDNSKNTLYLQMNSL RAEDTAVYYCAAGYQINSGNYNFKDYEYDYWGQGTLVTVSS |
| Exemplary anti-CD3 scFv (SEQ ID NO: 56) | QTVVTQEPSLTVSPGGTVTLTCASSTGAVTSGNYPNWVQQKP GQAPRGLIGGTKFLVPGTPARFSGSLLGGKAALTLSGVQPEDEA EYYCTLWYSNRWVFGGGTKLTVLGGGGSGGGGSGGGGSEVQ LVESGGGLVQPGGSLKLSCAASGFTFNKYAINWVRQAPGKGLE WVARIRSKYNNYATYYADQVKDRFTISRDDSKNTAYLQMNNL KTEDTAVYYCVRHANFGNSYISYWAYWGQGTLVTVSS |
| Exemplary anti-target (anti-PSMA) sdAb (SEQ ID NO: 57) | EVQLVESGGGLVQPGGSLTLSCAASRFMISEYHMHWVRQAPG KGLEWVSTINPAGTTDYAESVKGRFTISRDNAKNTLYLQMNSL KPEDTAVYYCDSYGYRGQGTQVTVSS |
| Exemplary anti-target (anti-PSMA) sdAb (SEQ ID NO: 63) | EVQLVESGGGLVQPGGSLRLSCAASRFMISEYHMHWVRQAP GKGLEWVSDINPAGTTDYAESVKGRFTISRDNAKNTLYLQMNS LRAEDTAVYYCDSYGYRGQGTLVTVSS |
| Exemplary anti-target (anti-PSMA) sdAb (SEQ ID NO: 64) | EVQLVESGGGLVQPGGSLRLSCAASRFMISEYHMHWVRQAP GKGLEWVSTINPAGTTDYAESVKGRFTISRDNAKNTLYLQMNS LRAEDTAVYYCDSYGYRGQGTLVTVSS |
| Exemplary anti-target (anti-PSMA) sdAb (SEQ ID NO: 65) | EVQLVESGGGLVQPGGSLRLSCAASRFMISEYSMHWVRQAPG KGLEWVSTINPAKTTDYAESVKGRFTISRDNAKNTLYLQMNSLR AEDTAVYYCDSYGYRGQGTLVTVSS |
| Exemplary anti-target (anti-PSMA) sdAb (SEQ ID NO: 66) | EVQLVESGGGLVQPGGSLRLSCAASRFMISPYSMHWVRQAPG KGLEWVSTINPAGTTDYAESVKGRFTISRDNAKNTLYLQMNSL RAEDTAVYYCDYGYRGQGTLVTVSS |
| Exemplary anti-target (anti-PSMA) sdAb (SEQ ID NO: 67) | EVQLVESGGGLVQPGGSLRLSCAASRFMISEYSMHWVRQAPG KGLEWVSTINPAGQTDYAESVKGRFTISRDNAKNTLYLQMNSL RAEDTAVYYCDSYGYRGQGTLVTVSS |
| Exemplary anti-target (anti-PSMA) sdAb (SEQ ID NO: 68) | EVQLVESGGGLVQPGGSLRLSCAASRFMISEYSMHWVRQAPG KGLEWVSTINPAGTTDYAEYVKGRFTISRDNAKNTLYLQMNSL RAEDTAVYYCDSYGYRGQGTLVTVSS |
| Exemplary anti-target (anti-PSMA) sdAb (SEQ ID NO: 69) | EVQLVESGGGLVQPGGSLRLSCAASRFMISEYHMHWVRQAP GKGLEWVSDINPAKTTDYAESVKGRFTISRDNAKNTLYLQMNS LRAEDTAVYYCDSYGYRGQGTLVTVSS |
| Exemplary anti-target (anti-PSMA) sdAb (SEQ ID NO: 70) | EVQLVESGGGLVQPGGSLRLSCAASRFMISPYHMHWVRQAP GKGLEWVSDINPAGTTDYAESVKGRFTISRDNAKNTLYLQMNS LRAEDTAVYYCDSYGYRGQGTLVTVSS |
| Exemplary anti-target (anti-PSMA) sdAb (SEQ ID NO: 71) | EVQLVESGGGLVQPGGSLRLSCAASRFMISEYHMHWVRQAP GKGLEWVSDINPAGQTDYAESVKGRFTISRDNAKNTLYLQMN SLRAEDTAVYYCDSYGYRGQGTLVTVSS |
| Exemplary anti-target (anti-PSMA) sdAb (SEQ ID NO: 72) | EVQLVESGGGLVQPGGSLRLSCAASRFMISEYHMHWVRQAP GKGLEWVSDINPAGTTDYAEYVKGRFTISRDNAKNTLYLQMNS LRAEDTAVYYCDSYGYRGQGTLVTVSS |
| Exemplary anti-target (anti-PSMA) sdAb (SEQ ID NO: 73) | EVQLVESGGGLVQPGGSLTLSCAASRFMISEYHMHWVRQAPG KGLEWVSDINPAGTTDYAESVKGRFTISRDNAKNTLYLQMNSL KPEDTAVYYCDSYGYRGQGTQVTVSS |
| Exemplary anti-CD3 scFv (SEQ ID NO: 74) | EVQLVESGGGLVQPGGSLKLSCAASGFTFNKYAINWVRQAPG KGLEWVARIRSKYNNYATYYADQVKDRFTISRDDSKNTAYLQM NNLKTEDTAVYYCVRHANFGNSYISYWAYWGQGTLVTVSSGG GGSGGGGSGGGGSQTVVTQEPSLTVSPGGTVTLTCASSTGAV TSGNYPNWVQQKPGQAPRGLIGGTKFLVPGTPARFSGSLLGG KAALTLSGVQPEDEAEYYCTLWYSNRWVFGGGTKLTVL |

SEQUENCE TABLE

| DESCRIPTION | SEQUENCE |
| --- | --- |
| Exemplary anti-CD3 scFv (SEQ ID NO: 75) | EVQLVESGGGLVQPGGSLKLSCAASGFEFNKYAMNWVRQAP GKGLEWVARIRSKYNKYATYYADSVKDRFTISRDDSKNTAYLQ MNNLKTEDTAVYYCVRHGNFGNSYISYWAYWGQGTLVTVSS GGGGSGGGGSGGGGSQTVVTQEPSLTVSPGGTVTLTCGSSFG AVTSGNYPNWVQQKPGQAPRGLIGGTKFLAPGTPARFSGSLL GGKAALTLSGVQPEDEAEYYCVLWYDNRWVFGGGTKLTVL |
| Exemplary anti-CD3 scFv (SEQ ID NO: 76) | EVQLVESGGGLVQPGGSLKLSCAASGFTFNKYAMNWVRQAP GKGLEWVARIRSKYNNYATYYADSVKDRFTISRDDSKNTAYLQ MNNLKTEDTAVYYCVRHGNFGNSHISYWAYWGQGTLVTVSS GGGGSGGGGSGGGGSQTVVTQEPSLTVSPGGTVTLTCGSSTG YVTSGNYPNWVQQKPGQAPRGLIGGTSFLAPGTPARFSGSLLG GKAALTLSGVQPEDEAEYYCVLWYSNRWIFGGGTKLTVL |
| Exemplary anti-CD3 scFv (SEQ ID NO: 77) | EVQLVESGGGLVQPGGSLKLSCAASGFMFNKYAMNWVRQAP GKGLEWVARIRSKSNNYATYYADSVKDRFTISRDDSKNTAYLQ MNNLKTEDTAVYYCVRHGNFGNSYISYWATWGQGTLVTVSS GGGGSGGGGSGGGGSQTVVTQEPSLTVSPGGTVTLTCGSSFG AVTSGNYPNWVQQKPGQAPRGLIGGTKLLAPGTPARFSGSLL GGKAALTLSGVQPEDEAEYYCVLWYSNSWVFGGGTKLTVL |
| Exemplary anti-CD3 scFv (SEQ ID NO: 78) | EVQLVESGGGLVQPGGSLKLSCAASGFTFNTYAMNWVRQAP GKGLEWVARIRSKYNNYATYYKDSVKDRFTISRDDSKNTAYLQ MNNLKTEDTAVYYCVRHGNFGNSPISYWAYWGQGTLVTVSS GGGGSGGGGSGGGGSQTVVTQEPSLTVSPGGTVTLTCGSSTG AVVSGNYPNWVQQKPGQAPRGLIGGTEFLAPGTPARFSGSLL GGKAALTLSGVQPEDEAEYYCVLWYSNRWVFGGGTKLTVL |
| Exemplary anti-CD3 scFv (SEQ ID NO: 79) | EVQLVESGGGLVQPGGSLKLSCAASGFTYNKYAMNWVRQAP GKGLEWVARIRSKYNNYATYYADEVKDRFTISRDDSKNTAYLQ MNNLKTEDTAVYYCVRHGNFGNSPISYWAYWGQGTLVTVSS GGGGGGGGSGGGGSQTVVTQEPSLTVSPGGTVTLTCGSSKG AVTSGNYPNWVQQKPGQAPRGLIGGTKELAPGTPARFSGSLL GGKAALTLSGVQPEDEAEYYCTLWYSNRWVFGGGTKLTVL |
| Exemplary anti-CD3 scFv (SEQ ID NO: 80) | EVQLVESGGGLVQPGGSLKLSCAASGNTFNKYAMNWVRQAP GKGLEWVARIRSKYNNYETYYADSVKDRFTISRDDSKNTAYLQ MNNLKTEDTAVYYCVRHTNFGNSYISYWAYWGQGTLVTVSSG GGGSGGGGSGGGGSQTVVTQEPSLTVSPGGTVTLTCGSSTGA VTSGYYPNWVQQKPGQAPRGLIGGTYFLAPGTPARFSGSLLGG KAALTLSGVQPEDEAEYYCVLWYSNRWVFGGGTKLTVL |
| Exemplary anti-CD3 scFv (SEQ ID NO: 81) | EVQLVESGGGLVQPGGSLKLSCAASGFTFNNYAMNWVRQAP GKGLEWVARIRSKYNNYATYYADAVKDRFTISRDDSKNTAYLQ MNNLKTEDTAVYYCVRHGNFGNSQISYWAYWGQGTLVTVSS GGGGSGGGGSGGGGSQTVVTQEPSLTVSPGGTVTLTCGSSTG AVTDGNYPNWVQQKPGQAPRGLIGGIKFLAPGTPARFSGSLL GGKAALTLSGVQPEDEAEYYCVLWYSNRWVFGGGTKLTVL |
| Exemplary anti-CD3 scFv (SEQ ID NO: 82) | EVQLVESGGGLVQPGGSLKLSCAASGFTFNKYAVNWVRQAPG KGLEWVARIRSKYNNYATYYADSVKDRFTISRDDSKNTAYLQM NNLKTEDTAVYYCVRHGNFGNSYISYWAYWGQGTLVTVSSGG GGSGGGGSGGGGSQTVVTQEPSLTVSPGGTVTLTCGESTGAV TSGNYPNWVQQKPGQAPRGLIGGTKILAPGTPARFSGSLLGGK AALTLSGVQPEDEAEYYCVLWYSNRWVFGGGTKLTVL |
| Exemplary anti-CD3 scFv (SEQ ID NO: 83) | EVQLVESGGGLVQPGGSLKLSCAASGFTFNKYPMNWVRQAP GKGLEWVARIRSKYNNYATYYADSVKDRFTISRDDSKNTAYLQ MNNLKNEDTAVYYCVRHGNFNNSYISYWAYWGQGTLVTVSS GGGGSGGGGSGGGGSQTVVTQEPSLTVSPGGTVTLTCGSSTG AVTKGNYPNWVQQKPGQAPRGLIGGTKMLAPGTPARFSGSLL GGKAALTLSGVQPEDEAEYYCALWYSNRWVFGGGTKLTVL |
| Exemplary anti-CD3 scFv (SEQ ID NO: 84) | EVQLVESGGGLVQPGGSLKLSCAASGFTFNGYAMNWVRQAP GKGLEWVARIRSKYNNYATYYADEVKDRFTISRDDSKNTAYLQ MNNLKTEDTAVYYCVRHGNFGNSPISYWAYWGQGTLVTVSS GGGGSGGGGSGGGGSQTVVTQEPSLTVSPGGTVTLTCGSSTG AVVSGNYPNWVQQKPGQAPRGLIGGTEFLAPGTPARFSGSLL GGKAALTLSGVQPEDEAEYYCVLWYSNRWVFGGGTKLTVL |
| Exemplary anti-CD3 scFv (SEQ ID NO: 85) | EVQLVESGGGLVQPGGSLKLSCAASGNTFNKYAMNWVRQAP GKGLEWVARIRSKYNNYATYYADSVKDRFTISRDDSKNTAYLQ MNNLKTEDTAVYYCVRHGNFGDSYISYWAYWGQGTLVTVSS |

SEQUENCE TABLE

| DESCRIPTION | SEQUENCE |
|---|---|
| | GGGGSGGGGSGGGGSQTVVTQEPSLTVSPGGTVTLTCGSSTG<br>AVTHGNYPNWVQQKPGQAPRGLIGGTKVLAPGTPARFSGSLL<br>GGKAALTLSGVQPEDEAEYYCVLWYSNRWVFGGGTKLTVL |
| Exemplary anti-CD3 scFv<br>(SEQ ID NO: 86) | EVQLVESGGGLVQPGGSLKLSCAASGFTNNYAMNWVRQAP<br>GKGLEWVARIRSGYNNYATYYADSVKDRFTISRDDSKNTAYLQ<br>MNNLKTEDTAVYYCVRHGNFGNSYISYWAYWGQGTLVTVSS<br>GGGGSGGGGSGGGGSQTVVTQEPSLTVSPGGTVTLTCGSYTG<br>AVTSGNYPNWVQQKPGQAPRGLIGGTKFNAPGTPARFSGSLL<br>GGKAALTLSGVQPEDEAEYYCVLWYANRWVFGGGTKLTVL |
| Exemplary anti-CD3 scFv<br>(SEQ ID NO: 87) | EVQLVESGGGLVQPGGSLKLSCAASGFEFNKYAMNWVRQAP<br>GKGLEWVARIRSKYNNYETYYADSVKDRFTISRDDSKNTAYLQ<br>MNNLKTEDTAVYYCVRHGNFGNSLISYWAYWGQGTLVTVSS<br>GGGGSGGGGSGGGGSQTVVTQEPSLTVSPGGTVTLTCGSSSG<br>AVTSGNYPNWVQQKPGQAPRGLIGGTKFGAPGTPARFSGSLL<br>GGKAALTLSGVQPEDEAEYYCVLWYSNRWVFGGGTKLTVL |
| Exemplary anti-CD3 scFv<br>(SEQ ID NO: 88) | EVQLVESGGGLVQPGGSLKLSCAASGFTNKYAMNWVRQAP<br>GKGLEWVARIRSKYNNYATYYADSVKDRFTISRDDSKNTAYLQ<br>MNNLKTEDTAVYYCVRHGNFGNSYISYWAYWGQGTLVTVSS<br>GGGGSGGGGSGGGGSQTVVTQEPSLTVSPGGTVTLTCGSSTG<br>AVTSGNYPNWVQQKPGQAPRGLIGGTKFLAPGTPARFSGSLL<br>GGKAALTLSGVQPEDEAEYYCVLWYSNRWVFGGGTKLTVL |
| Exemplary anti-CD3 scFv<br>(SEQ ID NO: 89) | EVQLVESGGGLVQPGGSLKLSCAASGFTNKYALNWVRQAPG<br>KGLEWVARIRSKYNNYATEYADSVKDRFTISRDDSKNTAYLQM<br>NNLKTEDTAVYYCVRHGNFGNSPISYWAYWGQGTLVTVSSGG<br>GGSGGGGSGGGGSQTVVTQEPSLTVSPGGTVTLTCGSSTGAV<br>TSGNYPNWVQQKPGQAPRGLIGGTNFLAPGTPERFSGSLLGG<br>KAALTLSGVQPEDEAEYYCVLWYSNRWAFGGGTKLTVL |
| Exemplary anti-CD3 scFv<br>(SEQ ID NO: 90) | EVQLVESGGGLVQPGGSLKLSCAASGFTNEYAMNWVRQAP<br>GKGLEWVARIRSKYNNYATYYADDVKDRFTISRDDSKNTAYLQ<br>MNNLKTEDTAVYYCVRHGNFGNSGISYWAYWGQGTLVTVSS<br>GGGGSGGGGSGGGGSQTVVTQEPSLTVSPGGTVTLTCGSSTG<br>AVTVGNYPNWVQQKPGQAPRGLIGGTEFLAPGTPARFSGSLL<br>GGKAALTLSGVQPEDEAEYYCVLWYSNRWVFGGGTKLTVL |
| Exemplary anti-target (BCMA)<br>(SEQ ID NO: 91) | EVQLVESGGGLVQPGRSLTLSCAASTNIFSISPMGWYRQAPGK<br>QRELVAAIHGFSTLYADSVKGRFTISRDNAKNSIYLQMNSLRPE<br>DTALYYCNKVPWGDYHPRNVYWGQGTQVTVSS |
| Exemplary anti-target (BCMA)<br>(SEQ ID NO: 92) | EVQLVESGGGLVQPGRSLTLSCAASTDIFSISPMGWYRQAPGK<br>QRELVAAIHGGSTLYADSVKGRFTISRDNAKNSIYLQMNSLRPE<br>DTALYYCNKVPWGDYHPRNVAWGQGTQVTVSS |
| Exemplary anti-target (BCMA)<br>(SEQ ID NO: 93) | EVQLVESGGGLVQPGRSLTLSCAASTNDFSISPMGWYRQAPG<br>KQRELVAAIHGGSTLYADSVKGRFTISRDNAKNSIYLQMNSLRP<br>EDTALYYCNKVPWGDYHPRNVAWGQGTQVTVSS |
| Exemplary anti-target (BCMA)<br>(SEQ ID NO: 94) | EVQLVESGGGLVQPGRSLTLSCAASTNIFSKSPMGWYRQAPGK<br>QRELVAAIHGKSTLYADSVKGRFTISRDNAKNSIYLQMNSLRPE<br>DTALYYCNKVPWGDYHPRNVVWGQGTQVTVSS |
| Exemplary anti-target (BCMA)<br>(SEQ ID NO: 95) | EVQLVESGGGLVQPGRSLTLSCAASTNDFSISPMGWYRQAPG<br>KQRELVAAIHGKSTLYADSVKGRFTISRDNAKNSIYLQMNSLRP<br>EDTALYYCNKVPWGDYHPRNVKWGQGTQVTVSS |
| Exemplary anti-target (BCMA)<br>(SEQ ID NO: 96) | EVQLVESGGGLVQPGRSLTLSCAASTNQFSISPMGWYRQAPG<br>KQRELVAAIHGKSTLYADSVKGRFTISRDNAKNSIYLQMNSLRP<br>EDTALYYCNKVPWGDYHPRNVVWGQGTQVTVSS |
| Exemplary anti-target (BCMA)<br>(SEQ ID NO: 97) | EVQLVESGGGLVQPGRSLTLSCAASTNIFSSSPMGWYRQAPGK<br>QRELVAAINGFSTLYADSVKGRFTISRDNAKNSIYLQMNSLRPE<br>DTALYYCNKVPWGDYHPRNVHWGQGTQVTVSS |
| Exemplary anti-target (BCMA)<br>(SEQ ID NO: 98) | EVQLVESGGGLVQPGRSLTLSCAASTNIFSSSPMGWYRQAPGK<br>QRELVAAIHGFSTLYADSVKGRFTISRDNAKNSIYLQMNSLRPE<br>DTALYYCNKVPWGDYHPRNVYWGQGTQVTVSS |
| Exemplary anti-target (BCMA)<br>(SEQ ID NO: 99) | EVQLVESGGGLVQPGRSLTLSCAASTNIFSTSPMGWYRQAPGK<br>QRELVAAIHGFQTLYADSVKGRFTISRDNAKNSIYLQMNSLRPE<br>DTALYYCNKVPWGDYHPRNVVWGQGTQVTVSS |

| SEQUENCE TABLE | |
|---|---|
| DESCRIPTION | SEQUENCE |
| Exemplary anti-target (BCMA) (SEQ ID NO: 100) | EVQLVESGGGLVQPGRSLTLSCAASTNIFSRSPMGWYRQAPGK QRELVAAIHGFETLYADSVKGRFTISRDNAKNSIYLQMNSLRPE DTALYYCNKVPWGDYHPRNVLWGQGTQVTVSS |
| Exemplary anti-target (BCMA) (SEQ ID NO: 101) | EVQLVESGGGLVQPGRSLTLSCAASTNIFSESPMGWYRQAPGK QRELVAAIHGFTTLYADSVKGRFTISRDNAKNSIYLQMNSLRPE DTALYYCNKVPWGDYHPRNVTWGQGTQVTVSS |
| Exemplary anti-target (BCMA) (SEQ ID NO: 102) | EVQLVESGGGLVQPGRSLTLSCAASTNIFSDSPMGWYRQAPG KQRELVAAIHGFSTLYADSVKGRFTISRDNAKNSIYLQMNSLRP EDTALYYCNKVPWGDYHPRNVAWGQGTQVTVSS |
| Exemplary anti-target (BCMA) (SEQ ID NO: 103) | EVQLVESGGGLVQPGRSLTLSCAASTNIFSNSPMGWYRQAPG KQRELVAAIHGGSTLYADSVKGRFTISRDNAKNSIYLQMNSLRP EDTALYYCNKVPWGDYHPRNVHWGQGTQVTVSS |
| Exemplary anti-target (BCMA) (SEQ ID NO: 104) | EVQLVESGGGLVQPGRSLTLSCAASTNIFSNSPMGWYRQAPG KQRELVAAIHGRSTLYADSVKGRFTISRDNAKNSIYLQMNSLRP EDTALYYCNKVPWGDYHPRNVMWGQGTQVTVSS |
| Exemplary anti-target (BCMA) (SEQ ID NO: 105) | EVQLVESGGGLVQPGRSLTLSCAASTNIFSNSPMGWYRQAPG KQRELVAAIHGPSTLYADSVKGRFTISRDNAKNSIYLQMNSLRP EDTALYYCNKVPWGDYHPRNVTWGQGTQVTVSS |
| Exemplary anti-target (BCMA) (SEQ ID NO: 106) | EVQLVESGGGLVQPGRSLTLSCAASTNIFSNSPMGWYRQAPG KQRELVAAIHGDSTLYADSVKGRFTISRDNAKNSIYLQMNSLRP EDTALYYCNKVPWGDYHPRNVRWGQGTQVTVSS |
| Exemplary anti-target (BCMA) (SEQ ID NO: 107) | EVQLVESGGGLVQPGRSLTLSCAASTNIFSRSPMGWYRQAPGK QRELVAAIHGDSTLYADSVKGRFTISRDNAKNSIYLQMNSLRPE DTALYYCNKVPWGDYHPRNVTWGQGTQVTVSS |
| Exemplary anti-target (BCMA) (SEQ ID NO: 108) | EVQLVESGGGLVQPGRSLTLSCAASTNIFSKSPMGWYRQAPGK QRELVAAIHGQSTLYADSVKGRFTISRDNAKNSIYLQMNSLRPE DTALYYCNKVPWGDYHPRNVTWGQGTQVTVSS |
| Exemplary anti-target (BCMA) (SEQ ID NO: 109) | EVQLVESGGGLVQPGRSLTLSCAASTNIFSSSPMGWYRQAPGK QRELVAAIHGHSTLYADSVKGRFTISRDNAKNSIYLQMNSLRPE DTALYYCNKVPWGDYHPRNVTWGQGTQVTVSS |
| Exemplary anti-target (BCMA) (SEQ ID NO: 110) | EVQLVESGGGLVQPGRSLTLSCAASTNIFSSSPMGWYRQAPGK QRELVAAIHGESTLYADSVKGRFTISRDNAKNSIYLQMNSLRPE DTALYYCNKVPWGDYHPRKVYWGQGTQVTVSS |
| Exemplary anti-target (BCMA) (SEQ ID NO: 111) | EVQLVESGGGLVQPGRSLTLSCAASTNIFSRSPMGWYRQAPGK QRELVAAIHGNSTLYADSVKGRFTISRDNAKNSIYLQMNSLRPE DTALYYCNKVPWGIYHPRNVYWGQGTQVTVSS |
| Exemplary anti-target (BCMA) (SEQ ID NO: 112) | EVQLVESGGGLVQPGRSLTLSCAASTNIFSESPMGWYRQAPGK QRELVAAIHGNSTLYADSVKGRFTISRDNAKNSIYLQMNSLRPE DTALYYCNKVPWGTYHPRNVYWGQGTQVTVSS |
| Exemplary anti-target (BCMA) (SEQ ID NO: 113) | EVQLVESGGGLVQPGRSLTLSCAASTNIFSVSPMGWYRQAPG KQRELVAAIHGNSTLYADSVKGRFTISRDNAKNSIYLQMNSLRP EDTALYYCNKVPWGKYHPRNVYWGQGTQVTVSS |
| Exemplary anti-target (BCMA) (SEQ ID NO: 114) | EVQLVESGGGLVQPGRSLTLSCAASTNIFSVSPMGWYRQAPG KQRELVAAIHGNSTLYADSVKGRFTISRDNAKNSIYLQMNSLRP EDTALYYCNKVPWGDYHPRNVYWGQGTQVTVSS |
| Exemplary anti-target (BCMA) (SEQ ID NO: 115) | EVQLVESGGGLVQPGRSLTLSCAASTNIFSKSPMGWYRQAPGK QRELVAAIHGNSTLYADSVKGRFTISRDNAKNSIYLQMNSLRPE DTALYYCNKVPWGDYHPREVYWGQGTQVTVSS |
| Exemplary anti-target (BCMA) (SEQ ID NO: 116) | EVQLVESGGGLVQPGRSLTLSCAASTNIFSDSPMGWYRQAPG KQRELVAAIHGTSTLYADSVKGRFTISRDNAKNSIYLQMNSLRP EDTALYYCNKVPWGDYHPRNVYWGQGTQVTVSS |
| Exemplary anti-target (BCMA) (SEQ ID NO: 117) | EVQLVESGGGLVQPGRSLTLSCAASTNIFSRSPMGWYRQAPGK QRELVAAIHGTSTLYADSVKGRFTISRDNAKNSIYLQMNSLRPE DTALYYCNKVPWGKYHPRNVYWGQGTQVTVSS |
| Exemplary anti-target (BCMA) (SEQ ID NO: 118) | EVQLVESGGGLVQPGRSLTLSCAASTNIFSHSPMGWYRQAPG KQRELVAAIHGTSTLYADSVKGRFTISRDNAKNSIYLQMNSLRP EDTALYYCNKVPWGRYHPRNVYWGQGTQVTVSS |

| SEQUENCE TABLE | |
|---|---|
| DESCRIPTION | SEQUENCE |
| Exemplary anti-target (BCMA) (SEQ ID NO: 119) | EVQLVESGGGLVQPGRSLTLSCAASTNIFSTSPMGWYRQAPGK QRELVAAIHGTSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 120) | EVQLVESGGGLVQPGRSLTLSCAASTNIFSTSPMGWYRQAPGK QRELVAAIHGTSTLYADSVKGRFTISRDNAKNSIYLQMNSLRPE DTALYYCNKVPWGDYHPRNVQWGQGTQVTVSS |
| Exemplary anti-target (BCMA) (SEQ ID NO: 121) | EVQLVESGGGLVQPGRSLTLSCAASTNIFSLSPMGWYRQAPGK QRELVAAIHGDSTLYADSVKGRFTISRDNAKNSIYLQMNSLRPE DTALYYCNKVPWGDYHPRNVYWGQGTQVTVSS |
| Exemplary anti-target (BCMA) (SEQ ID NO: 122) | EVQLVESGGGLVQPGRSLTLSCAASTNIFSISPGGWYRQAPGK QRELVAAIHGSSTLYADSVKGRFTISRDNAKNSIYLQMNSLRPE DTALYYCNKVPWGDYHPRNVYWGQGTQVTVSS |
| Exemplary anti-target (BCMA) (SEQ ID NO: 123) | EVQLVESGGGLVQPGRSLTLSCAASTNHFSISPMGWYRQAPG KQRELVAAIHGSSTLYADSVKGRFTISRDNAKNSIYLQMNSLRP EDTALYYCNKVPWGDYHPRVVYWGQGTQVTVSS |
| Exemplary anti-target (BCMA) (SEQ ID NO: 124) | EVQLVESGGGLVQPGRSLTLSCAASTNIFSASPMGWYRQAPG KQRELVAAIHGSSTLYADSVKGRFTISRDNAKNSIYLQMNSLRP EDTALYYCNKVPWGDYHPRNVNWGQGTQVTVSS |
| Exemplary anti-target (BCMA) (SEQ ID NO: 125) | EVQLVESGGGLVQPGRSLTLSCAASTNIFSASPMGWYRQAPG KQRELVAAIHGSSTLYADSVKGRFTISRDNAKNSIYLQMNSLRP EDTALYYCNKVPWGRYHPRNVYWGQGTQVTVSS |
| Exemplary anti-target (BCMA) (SEQ ID NO: 126) | EVQLVESGGGLVQPGRSLTLSCAASTNISSISPMGWYRQAPGK QRELVAAIHGTSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 127) | EVQLVESGGGLVQPGRSLTLSCAASTNIESISPMGWYRQAPGK QRELVAAIHGTSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 128) | EVQLVESGGGLVQPGRSLTLSCAASTNIFSISPYGWYRQAPGKQ RELVAAIHGTSTLYADSVKGRFTISRDNAKNSIYLQMNSLRPEDT ALYYCNKVPWGDYHPGNVYWGQGTQVTVSS |
| Exemplary anti-target (BCMA) (SEQ ID NO: 129) | EVQLVESGGGLVQPGRSLTLSCAASTNIASISPMGWYRQAPGK QRELVAAIHGTSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 130) | EVQLVESGGGLVQPGRSLTLSCAASTNIASISPMGWYRQAPGK QRELVAAIHGKSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 131) | EVQLVESGGGLVQPGRSLTLSCAASTNIASISPMGWYRQAPGK QRELVAAIHGSSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 132) | EVQLVESGGGLVQPGRSLTLSCAASTNITSISPMGWYRQAPGK QRELVAAIHGDSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 133) | EVQLVESGGGLVQPGRSLTLSCAASTNIMSISPMGWYRQAPG KQRELVAAIHGNSTLYADSVKGRFTISRDNAKNSIYLQMNSLRP EDTALYYCNKVPWGDYHPGNVYWGQGTQVTVSS |
| Exemplary anti-target (BCMA) (SEQ ID NO: 134) | EVQLVESGGGLVQPGRSLTLSCAASTNITSISPMGWYRQAPGK QRELVAAIHGNSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 135) | EVQLVESGGGLVQPGRSLTLSCAASTNIVSISPMGWYRQAPGK QRELVAAIHGHSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 136) | EVQLVESGGGLVQPGRSLTLSCAASTNIVSISPMGWYRQAPGK QRELVAAIHGKSTLYADSVKGRFTISRDNAKNSIYLQMNSLRPE DTALYYCNKVPWGDYHPGNVYWGQGTQVTVSS |

| SEQUENCE TABLE | |
|---|---|
| DESCRIPTION | SEQUENCE |
| Exemplary anti-target (BCMA) (SEQ ID NO: 137) | EVQLVESGGGLVQPGRSLTLSCAASTNVVSISPMGWYRQAPG KQRELVAAIHGKSTLYADSVKGRFTISRDNAKNSIYLQMNSLRP EDTALYYCNKVPWGDYHPNNVYWGQGTQVTVSS |
| Exemplary anti-target (BCMA) (SEQ ID NO: 138) | EVQLVESGGGLVQPGRSLTLSCAASTNIISISPMGWYRQAPGK QRELVAAIHGASTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 139) | EVQLVESGGGLVQPGRSLTLSCAASTNIFSITPMGWYRQAPGK QRELVAAIHGASTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 140) | EVQLVESGGGLVQPGRSLTLSCAASTNITSISPMGWYRQAPGK QRELVAAIHGFETLYADSVKGRFTISRDNAKNSIYLQMNSLRPE DTALYYCNKVPWGDYHPGNVYWGQGTQVTVSS |
| Exemplary anti-target (BCMA) (SEQ ID NO: 141) | EVQLVESGGGLVQPGRSLTLSCAASTNIQSISPMGWYRQAPGK QRELVAAIHGFETLYADSVKGRFTISRDNAKNSIYLQMNSLRPE DTALYYCNKVPWGDYHPGNVYWGQGTQVTVSS |
| Exemplary anti-target (BCMA) (SEQ ID NO: 142) | EVQLVESGGGLVQPGRSLTLSCAASTSDFSISPMGWYRQAPGK QRELVAAIHGFETLYADSVKGRFTISRDNAKNSIYLQMNSLRPE DTALYYCNKVPWGDYHPGNVYWGQGTQVTVSS |
| Exemplary anti-target (BCMA) (SEQ ID NO: 143) | EVQLVESGGGLVQPGRSLTLSCAASTNIDSISPMGWYRQAPGK QRELVAAIHGFQTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 144) | EVQLVESGGGLVQPGRSLTLSCAASTNIMSISPMGWYRQAPG KQRELVAAIHGFSTVYADSVKGRFTISRDNAKNSIYLQMNSLRP EDTALYYCNKVPWGDYHPGNVYWGQGTQVTVSS |
| Exemplary anti-target (BCMA) (SEQ ID NO: 145) | EVQLVESGGGLVQPGRSLTLSCAASTNIESISPMGWYRQAPGK QRELVAAIHGFSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 146) | EVQLVESGGGLVQPGRSLTLSCAASTNIFSSSPMGWYRQAPGK QRELVAAIHGFKTLYADSVKGRFTISRDNAKNSIYLQMNSLRPE DTARYYCNKVPWGDYHPGNVYWGQGTQVTVSS |
| Exemplary anti-target (BCMA) (SEQ ID NO: 147) | EVQLVESGGGLVQPGRSLTLSCAASTNIFSSSPMGWYRQAPGK QRELVAAIHGFSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 148) | EVQLVESGGGLVQPGRSLTLSCAASTNIFSNSPMGWYRQAPG KQRELVAAIHGFSTLYADSVKGRFTISRDNAKNSIYLQMNSLRP EDTALYYCNKVPWGDYHPGNVYWGQGTQVTVSS |
| Exemplary anti-target (BCMA) (SEQ ID NO: 149) | EVQLVESGGGLVQPGRSLTLSCAASTNIFSTSPMGWYRQAPGK QRELVAAIHGFSTIYADSVKGRFTISRDNAKNSIYLQMNSLRPED TALYYCNKVPWGDYHPGNVYWGQGTQVTVSS |
| Exemplary anti-target (BCMA) (SEQ ID NO: 150) | EVQLVESGGGLVQPGRSLTLSCAASTNIFSTSPMGWYRQAPGK QRELVAAIHGFSTIYADSVKGRFTISRDNAKNSIYLQMNSLRPED TALYYCNKVPWGDYHPLNVYWGQGTQVTVSS |
| Exemplary anti-target (BCMA) (SEQ ID NO: 151) | EVQLVESGGGLVQPGRSLTLSCVASTNIFSTSPMGWYRQAPGK QRELVAAIHGFSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 152) | EVQLVESGGGLVQPGRSLTLSCAASTNIFSDSPMGWYRQAPG KQRELVAAIHGFSTFYADSVKGRFTISRDNAKNSIYLQMNSLRP EDTALYYCNKVPWGDYHPGNVYWGQGTQVTVSS |
| Exemplary anti-target (BCMA) (SEQ ID NO: 153) | EVQLVESGGGLVQPGRSLTLSCAASTNIFSQSPMGWYRQAPG KQRELVAAIHGDSTLYADSVKGRFTISRDNAKNSIYLQMNSLRP EDTALYYCNKVPWGDYHPGNVCWGQGTQVTVSS |
| Exemplary anti-target (BCMA) (SEQ ID NO: 154) | EVQLVESGGGLVQPGRSLTLSCAASTNIFSQSPMGWYRQAPG KQRELVAAIHGKSTLYADSVKGRFTISRDNAKNSIYLQMNSLRP EDTALYYCNKVPWGDYHPSNVYWGKGTQVTVSS |

| SEQUENCE TABLE | |
|---|---|
| DESCRIPTION | SEQUENCE |
| Exemplary anti-target (BCMA) (SEQ ID NO: 155) | EVQLVESGGGLVQPGRSLTLSCAASTNIFSRSPMGWYRQAPGK QRELVAAIHGESTLYADSVKGRFTISRDNAKNSIYLQMNSLRPE DTALYYCNKVPWGRYHPGNVYWGQGTQVTVSS |
| Exemplary anti-target (BCMA) (SEQ ID NO: 156) | EVQLVESGGGLVQPGRSLTLSCAASTNIFSRSPMGWYRQAPGK QRELVAAIHGISTLYADSVKGRFTISRDNAKNSIYLQMNSLRPED TALYYCNKVPWGDYHPGNVYWGQGTQVTVSS |
| Exemplary anti-target (BCMA) (SEQ ID NO: 157) | EVQLVESGGGLVQPGRSLTLSCAASTNIFSRSPMGWYRQAPGK QRELVAAIHGSSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 158) | EVQLVESGGGLVQPGRSLTLSCAASTNIFSGSPMGWYRQAPG KQRELVAAIHGNSTLYADSVKGRFTISRDNAKNSIYLQMNSLRP EDTALYYCNKVPWGDYHPGNVYWGQGTQVTVSS |
| Exemplary anti-target (BCMA) (SEQ ID NO: 159) | EVQLVESGGGLVQPGRSLTLSCAASSNIFSISPMGWYRQAPGK QRELVAAIHGSSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 160) | EVQLVESGGGLVQPGRSLTLSCAASTNIFSIYPMGWYRQAPGK QRELVAAIHGSSTLYADSVKGRFTISRDNAKNSIYLQMNSLRPE DTALYYCNKVPWGDYHPKNVYWGQGTQVTVSS |
| Exemplary anti-target (BCMA) (SEQ ID NO: 161) | EVQLVESGGGLVQPGRSLTLSCAASTNIFSKSPMGWYRQAPGK QRELVAAIHGSSTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 162) | EVQLVESGGGLVQPGRSLTLSCAASTNIFSKSPMGWYRQAPGK QRELVAAIHGSSTLYADSVKGRFTISRDNAKNSIYLQMNSLRPE DTALYYCNKVPWGDYHPRNVYWGQGTQVTVSS |
| Exemplary anti-target (BCMA) (SEQ ID NO: 163) | EVQLVESGGGLVQPGRSLTLSCAASTNEFSISPMGWYRQAPGK QRELVAAIHGLSTLYADSVKGRFTISRDNAKNSIYLQMNSLRPE DTALYYCNKVPWGAYHPRNVYWGQGTQVTVSS |
| Exemplary anti-target (BCMA) (SEQ ID NO: 164) | EVQLVESGGGLVQPGRSLTLSCAASTNEFSISPMGWYRQAPGK QRELVAAIHGESTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 165) | EVQLVESGGGLVQPGRSLTLSCAASTNIPSISPMGWYRQAPGK QRELVAAIHGESTLYADSVKGRFTISRDNAKNSIYLQMNSLRPE DTALYYCNKVPWGDYHPRNVAWGQGTQVTVSS |
| Exemplary anti-target (BCMA) (SEQ ID NO: 166) | EVQLVESGGGLVQPGRSLTLSCAASTNIPSISPMGWYRQAPGK QRELVAAIHGASTLYADSVKGRFTISRDNAKNSIYLQMNSLRPE DTALYYCNKVPWGDYHPRNVAWGQGTQVTVSS |
| Exemplary anti-target (BCMA) (SEQ ID NO: 167) | EVQLVESGGGLVQPGRSLTLSCAASTNIPSISPMGWYRQAPGK QRELVAAIHGESTLYADSVKGRFTISRDNAKNSIYLQMNSLRPE DTALYYCNKVPWGDYHPRNVYWGQGTQVTVSS |
| Exemplary anti-target (BCMA) (SEQ ID NO: 168) | EVQLVESGGGLVQPGRSLTLSCAASTNIPSISPMGWYRQAPGK QRELVAAIHGDSTLYADSVKGRFTISRDNAKNSIYLQMNSLRPE DTALYYCNKVPWGDYHPRNVYWGQGTQVTVSS |
| Exemplary anti-target (BCMA) (SEQ ID NO: 169) | EVQLVESGGGLVQPGRSLTLSCAASTNITSISPMGWYRQAPGK QRELVAAIHGVSTLYADSVKGRFTISRDNAKNSIYLQMNSLRPE DTALYYCNKVPWGDYHPRNVQWGQGTQVTVSS |
| Exemplary anti-target (BCMA) (SEQ ID NO: 170) | EVQLVESGGGLVQPGRSLTLSCAASTNIPSISPMGWYRQAPGK QRELVAAIHGQSTLYADSVKGRFTISRDNAKNSIYLQMNSLRPE DTALYYCNKVPWGDYHPRNVQWGQGTQVTVSS |
| Exemplary anti-target (BCMA) (SEQ ID NO: 171) | EVQLVESGGGLVQPGRSLTLSCAASTNIVSISPMGWYRQAPGK QRELVAAIHGDSTLYADSVKGRFTISRDNAKNSIYLQMNSLRPE DTALYYCNKVPWGDYHPRNVSWGQGTQVTVSS |
| Exemplary anti-target (BCMA) (SEQ ID NO: 172) | EVQLVESGGGLVQPGRSLTLSCAASSNIFSISPMGWYRQAPGK QRELVAAIHGESTLYADSVKGRFTISRDNAKNSIYLQMNSLRPE DTALYYCNKVPWGDYHPRNVTWGQGTQVTVSS |

SEQUENCE TABLE

| DESCRIPTION | SEQUENCE |
|---|---|
| Exemplary anti-target (BCMA) (SEQ ID NO: 173) | EVQLVESGGGLVQPGRSLTLSCAASTNIDSISPMGWYRQAPGK QRELVAAIHGESTLYADSVKGRFTISRDNAKNSIYLQMNSLRPE DTALYYCNKVPWGDYHPRNVTWGQGTQVTVSS |
| Exemplary anti-target (BCMA) (SEQ ID NO: 174) | EVQLVESGGGLVQPGRSLTLSCAASTNIDSISPMGWYRQAPGK QRELVAAIHGSSTLYADSVKGRFTISRDNAKNSIYLQMNSLRPE DTALYYCNKVPWGDYHPRNVTWGQGTQVTVSS |
| Exemplary anti-target (BCMA) (SEQ ID NO: 175) | EVQLVESGGGLVQPGRSLTLSCAASTNIRSISPMGWYRQAPGK QRELVAAIHGSSTLYADSVKGRFTISRDNAKNSIYLQMNSLRPE DTALYYCNKVPWGDYHPRNVVWGQGTQVTVSS |
| Exemplary anti-target (BCMA) (SEQ ID NO: 176) | EVQLVESGGGLVQPGRSLTLSCAASTNITSISPMGWYRQAPGK QRELVAAISGFSTLYADSVKGRFTISRDNAKNSIYLQMNSLRPED TALYYCNEVPWGDYHPRNVYWGQGTQVTVSS |
| Exemplary anti-target (BCMA) (SEQ ID NO: 177) | EVQLVESGGGLVQPGRSLTLSCAASTNITSISPMGWYRQAPGK QRELVAAIHGESTLYADSVKGRFTISRDNAKNSIYLQMNSLRPE DTALYYCNKVPWGDYHPRNVYWGQGTQVTVSS |
| Exemplary anti-target (BCMA) (SEQ ID NO: 178) | EVQLVESGGGLVQPGRSLTLSCAASTNITSVSPMGWYRQAPG KQRELVAAIHGPSTLYADSVKGRFTISRDNAKNSIYLQMNSLRP EDTALYYCNKVPWGDYHPTNVYWGQGTQVTVSS |
| Exemplary anti-target (BCMA) (SEQ ID NO: 179) | EVQLVESGGGLVQPGRSLTLSCAASTNIGSISPMGWYRQAPGK QRELVAAIHGQSTLYADSVKGRFTISRDNAKNSIYLQMNSLRPE DTALYYCNKVPWGDYHPQNVYWGQGTQVTVSS |
| Exemplary anti-target (BCMA) (SEQ ID NO: 180) | EVQLVESGGGLVQPGRSLTLSCAASTNIESISPMGWYRQAPGK QRELVAAIHGKSTLYADSVKGRFTISRDNAKNSIYLQMNSLRPE DTALYYCNKVPWGDYHPRRVYWGQGTQVTVSS |
| Exemplary anti-target (BCMA) (SEQ ID NO: 189) | EVQLVESGGGLVQPGRSLTLSCAASTNIVSISPMGWYRQAPGK QRELVAAIHGDSTLYADSVKGRFTISRDNAKNSIYLQMNSLRPE DTALYYCNKVPWGDYHPRRVYWGQGTQVTVSS |
| Exemplary anti-target (BCMA) (SEQ ID NO: 190) | EVQLVESGGGLVQPGRSLTLSCAASTNIDSISPMGWYRQAPGK QRELVAAIHGNSTLYADSVKGRFTISRDNAKNSIYLQMNSLRPE DTALYYCNKVPWGDYHPRMVYWGQGTQVTVSS |
| Exemplary anti-target (BCMA) (SEQ ID NO: 191) | EVQLVESGGGLVQPGRSLTLSCAASTNIFMISPMGWYRQAPG KQRELVAAIHGDSTLYADSVKGRFTISRDNAKNSIYLQMNSLRP EDTALYYCNKVPWGRYHPRNVYWGQGTQVTVSS |
| Exemplary anti-target (BCMA) (SEQ ID NO: 192) | EVQLVESGGGLVQPGRSLTLSCAASTNIFRISPMGWYRQAPGK QRELVAAIHGDSTLYADSVKGRFTISRDNAKNSIYLQMNSLRPE DTALYYCNKVPWGRYHPRNVYWGQGTQVTVSS |
| Exemplary anti-target (BCMA) (SEQ ID NO: 193) | EVQLVESGGGLVQPGRSLTLSCAASTNIFSISPMGWYRQAPGK QRELVAAIHGDSTLYADSVKGRFTISRDNAKNSIYLQMNSLRPE DTALYYCNKVPWGEYHPRNVYWGQGTQVTVSS |
| Exemplary anti-target (BCMA) (SEQ ID NO: 194) | EVQLVESGGGLVQPGRSLTLSCAASTNIFSISPMGWYRQAPGK QRELVAAIHGDSTLYADSVKGRFTISRDNAKNSIYLQMNSLRPE DTALYYCNKVPWGKYHPRNVYWGQGTQVTVSS |
| Exemplary anti-target (BCMA) (SEQ ID NO: 195) | EVQLVESGGGLVQPGRSLTLSCAASTNIESISPMGWYRQAPGK QRELVAAIHGSSTLYADSVKGRFTISRDNAKNSIYLQMNSLRPE DTALYYCNKVPWGRYHPRNVYWGQGTQVTVSS |
| Exemplary anti-target (BCMA) (SEQ ID NO: 196) | EVQLVESGGGLVQPGRSLTLSCAASTNIESISPMGWYRQAPGK QRELVAAIHGNSTLYADSVKGRFTISRDNAKNSIYLQMNSLRPE DTALYYCNKVPWGRYHPRNVYWGQGTQVTVSS |
| Exemplary anti-target (BCMA) (SEQ ID NO: 197) | EVQLVESGGGLVQPGRSLTLSCAASTNISSISPMGWYRQAPGK QRELVAAIHGFSTLYADSVKGRFTISRDNAKNSIYLQMNSLRPE DTALYYCNKVPWGYYHPRNVYWGQGTQVTVSS |
| Exemplary anti-target (BCMA) (SEQ ID NO: 198) | EVQLVESGGGLVQPGRSLTLSCAASTNISSISPMGWYRQAPGK QRELVAAIHGHSTLYADSVKGRFTISRDNAKNSIYLQMNSLRPE DTALYYCNKVPWGRYHPRNVYWGQGTQVTVSS |
| Exemplary anti-target (BCMA) (SEQ ID NO: 199) | EVQLVESGGGLVQPGRSLTLSCAASTNISSISPMGWYRQAPGK QRELVAAIHGFSTVYADSVKGRFTISRDNAKNSIYLQMNSLRPE DTALYYCNKVPWGRYHPRNVYWGQGTQVTVSS |

| SEQUENCE TABLE | |
|---|---|
| DESCRIPTION | SEQUENCE |
| Exemplary anti-target (BCMA) (SEQ ID NO: 200) | EVQLVESGGGLVQPGRSLTLSCAASTNIFSIRPMGWYRQAPGK QRELVAAIHGFSTVYADSVKGRFTISRDNAKNSIYLQMNSLRPE DTALYYCNKVPWGDYHPRNVYWGQGTQVTVSS |
| Exemplary anti-target (BCMA) (SEQ ID NO: 201) | EVQLVESGGGLVQPGRSLTLSCAASTNIFSIYPMGWYRQAPGK QRELVAAIHGFSTYYADSVKGRFTISRDNAKNSIYLQMNSLRPE DTALYYCNKVPWGSYHPRNVYWGQGTQVTVSS |
| Exemplary anti-target (BCMA) (SEQ ID NO: 202) | EVQLVESGGGLVQPGRSLTLSCAASTNIFNISPMGWYRQAPGK QRELVAAIHGFSTYYADSVKGRFTISRDNAKNSIYLQMNSLRPE DTALYYCNKVPWGRYHPRNVYWGQGTQVTVSS |
| Exemplary anti-target (BCMA) (SEQ ID NO: 203) | EVQLVESGGGLVQPGRSLTLSCAASTNIFSSSPMGWYRQAPGK QRELVAAIHGFSTWYADSVKGRFTISRDNAKNSIYLQMNSLRP EDTALYYCNKVPWGRYHPRNVYWGQGTQVTVSS |
| Exemplary anti-target (BCMA) (SEQ ID NO: 204) | EVQLVESGGGLVQPGRSLTLSCAASTNISSISPMGWYRQAPGK QRELVAAIHGFDTLYADSVKGRFTISRDNAKNSIYLQMNSLRPE DTALYYCNKVPWGDYHPRNVYWGQGTQVTVSS |
| Exemplary anti-target (BCMA) (SEQ ID NO: 205) | EVQLVESGGGLVQPGRSLTLSCAASTNIFSINPMGWYRQAPGK QRELVAAIHGFDTLYADSVKGRFTISRDNAKNSIYLQMNSLRPE DTALYYCNKVPWGDYHPRNVSWGQGTQVTVSS |
| Exemplary anti-target (BCMA) (SEQ ID NO: 206) | EVQLVESGGGLVQPGRSLTLSCAASTNIFSITPMGWYRQAPGK QRELVAAIHGRSTLYADSVKGRFTISRDNAKNSIYLQMNSLRPE DTALYYCNKVPWGSYHPRNVYWGQGTQVTVSS |
| Exemplary anti-target (BCMA) (SEQ ID NO: 207) | EVQLVESGGGLVQPGRSLTLSCAASTNIFSITPMGWYRQAPGK QRELVAAIHGTSTLYADSVKGRFTISRDNAKNSIYLQMNSLRPE DTALYYCNKVPWGRYHPRNVYWGQGTQVTVSS |
| Exemplary anti-target (BCMA) (SEQ ID NO: 208) | EVQLVESGGGLVQPGRSLTLSCAASTNIFSITPMGWYRQAPGK QRELVAAIHGESTLYADSVKGRFTISRDNAKNSIYLQMNSLRPE DTALYYCNKVPWGRYHPRNVYWGQGTQVTVSS |
| Exemplary anti-target (BCMA) (SEQ ID NO: 209) | EVQLVESGGGLVQPGRSLTLSCAASTNIFSITPMGWYRQAPGK QRELVAAIHGESTLYADSVKGRFTISRDNAKNSIYLQMNSLRPE DTALYYCNKVPWGDYHPRDVYWGQGTQVTVSS |
| Exemplary anti-target (BCMA) (SEQ ID NO: 210) | EVQLVESGGGLVQPGRSLTLSCAASTNIFSTSPYGWYRQAPGK QRELVAAIHGFSTIYADSVKGRFTISRDNAKNSIYLQMNSLRPED TALYYCNKVPWGDYHPGNVYWGQGTQVTVSS |
| Exemplary anti-target (BCMA) (SEQ ID NO: 211) | EVQLVESGGGLVQPGRSLTLSCAASTNIFSTSPGGWYRQAPGK QRELVAAIHGFSTIYADSVKGRFTISRDNAKNSIYLQMNSLRPED TALYYCNKVPWGDYHPGNVYWGQGTQVTVSS |
| Exemplary anti-target (BCMA) (SEQ ID NO: 212) | EVQLVESGGGLVQPGRSLTLSCAASTNIFSITPYGWYRQAPGK QRELVAAIHGASTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 213) | EVQLVESGGGLVQPGRSLTLSCAASTNIFSITPGGWYRQAPGK QRELVAAIHGASTLYADSVKGRFTISRDNAKNSIYLQMNSLRPE DTALYYCNKVPWGDYHPGNVYWGQGTQVTVSS |
| Exemplary anti-target (BCMA) (SEQ ID NO: 214) | QVQLVESGGGLVQPGESLRLSCAASTNIFSISPMGWYRQAPGK QRELVAAIHGFSTLYADSVKGRFTISRDNAKNTIYLQMNSLKPE DTAVYYCNKVPWGDYHPRNVYWGQGTQVTVSS |
| Exemplary anti-target (MSLN) (SEQ ID NO: 215) | QVQLVESGGGLVQPGGSLRLSCAASGRTFSVRGMAWYRQAG NNRALVATMNPDGFPNYADAVKGRFTISWDIAENTVYLQMN SLNSEDTTVYYCNSGPYWGQGTQVTVSS |
| Exemplary anti-target (MSLN) (SEQ ID NO: 216) | QVQLVESGGGLVQAGGSLRLSCAASGSIPSIEQMGWYRQAPG KQRELVAALTSGGRANYADSVKGRFTISGDNVRNMVYLQMNS LKPEDTAIYYCSAGRFKGDYAQRSGMDYWGKGTLVTVSS |
| Exemplary anti-target (MSLN) (SEQ ID NO: 217) | QVQLVESGGGLVQAGGSLRLSCAFSGTTYTFDLMSWYRQAPG KQRTVVASISSDGRTSYADSVRGRFTISGENGKNTVYLQMNSL KLEDTAVYYCLGQRSGVRAFWGQGTQVTVSS |

SEQUENCE TABLE

| DESCRIPTION | SEQUENCE |
| --- | --- |
| Exemplary anti-target (MSLN) (SEQ ID NO: 218) | QVQLVESGGGLVQAGGSLRLSCVASGSTSNINNMRWYRQAP GKERELVAVITRGGYAIYLDAVKGRFTISRDNANNAIYLEMNSL KPEDTAVYVCNADRVEGTSGGPQLRDYFGQGTQVTVSS |
| Exemplary anti-target (MSLN) (SEQ ID NO: 219) | QVQLVESGGGLVQAGGSLRLSCAASGSTFGINAMGWYRQAP GKQRELVAVISRGGSTNYADSVKGRFTISRDNAENTVSLQMNT LKPEDTAVYFCNARTYTRHDYWGQGTQVTVSS |
| Exemplary anti-target (MSLN) (SEQ ID NO: 220) | QVRLVESGGGLVQAGGSLRLSCAASISAFRLMSVRWYRQDPSK QREWVATIDQLGRTNYADSVKGRFAISKDSTRNTVYLQMNML RPEDTAVYYCNAGGGPLGSRWLRGRHWGQGTQVTVSS |
| Exemplary anti-target (MSLN) (SEQ ID NO: 221) | QVRLVESGGGLVQAGESLRLSCAASGRPFSINTMGWYRQAPG KQRELVASISSSGDFTYTDSVKGRFTISRDNAKNTVYLQMNSLK PEDTAVYYCNARRTYLPRRFGSWGQGTQVTVSS |
| Exemplary anti-target (MSLN) (SEQ ID NO: 222) | QVQPVESGGGLVQPGGSLRLSCVVSGSDFTEDAMAWYRQAS GKERESVAFVSKDGKRILYLDSVRGRFTISRDIDKKTVYLQMDNL KPEDTGVYYCNSAPGAARNYWGQGTQVTVSS |
| Exemplary anti-target (MSLN) (SEQ ID NO: 223) | QVQPVESGGGLVQPGGSLRLSCVVSGSDFTEDAMAWYRQAS GKERESVAFVSKDGKRILYLDSVRGRFTISRDIYKKTVYLQMDNL KPEDTGVYYCNSAPGAARNVWGQGTQVTVSS |
| Exemplary anti-target (MSLN) (SEQ ID NO: 224) | EVQLVESGGGLVQPGNSLRLSCAASGFTFSSFGMSWVRQAPG KGLEWVSSISGSGSDTLYADSVKGRFTISRDNAKTTLYLQMNSL RPEDTAVYYCTIGGSLSRSSQGTLVTVSS |
| Exemplary anti-target (MSLN) (SEQ ID NO: 225) | QVQIVESGGGLVQAGGSLRLSCVASGLTYSIVAVGWYRQAPGK EREMVADISPVGNTNYADSVKGRFTISKENAKNTVYLQMNSLK PEDTAVYYCHIVRGWLDERPGPGPIVYWGQGTQVTVSS |
| Exemplary anti-target (MSLN) (SEQ ID NO: 226) | QVQLVESGGGLVQTGGSLRLSCAASGLTFGVYGMEWFRQAP GKQREWVASHTSTGYVYYRDSVKGRFTISRDNAKSTVYLQMN SLKPEDTAIYYCKANRGSYEYWGQGTQVTVSS |
| Exemplary anti-target (MSLN) (SEQ ID NO: 227) | QVQLVESGGGLVQAGGSLRLSCAASTTSSINSMSWYRQAQGK QREPVAVITDRGSTSYADSVKGRFTISRDNAKNTVYLQMNSLK PEDTAIYTCHVIADWRGYWGQGTQVTVSS |
| Exemplary anti-target (MSLN) (SEQ ID NO: 228) | QVQLVESGGGLVQAGGSLRLSCAASGRTLSRYAMGWFRQAP GKERQFVAAISRSGGTTRYSDSVKGRFTISRDNAANTFYLQMN NLRPDDTAVYYCNVRRRGWGRTLEYWGQGTQVTVSS |
| Exemplary anti-target (MSLN) (SEQ ID NO: 229) | QVQLGESGGGLVQAGGSLRLSCAASGSIFSPNAMIWHRQAPG KQREPVASINSSGSTNYGDSVKGRFTVSRDIVKNTMYLQMNSL KPEDTAVYYCSYSDFRRGTQYWGQGTQVTVSS |
| Exemplary anti-target (MSLN) (SEQ ID NO: 230) | QVQLVESGGGLVPSGGSLRLSCAASGATSAITNLGWYRRAPGQ VREMVARISVREDKEDYEDSVKGRFTISRDNTQNLVYLQMNNL QPHDTAIYYCGAQRWGRGPGTTWGQGTQVTVSS |
| Exemplary anti-target (MSLN) (SEQ ID NO: 231) | QVQLVESGGGLVQAGGSLRLSCAASGSTFRIRVMRWYRQAPG TERDLVAVISGSSTYYADSVKGRFTISRDNAKNTLYLQMNNLKP EDTAVYYCNADDSGIARDYWGQGTQVTVSS |
| Exemplary anti-target (MSLN) (SEQ ID NO: 232) | QVQLVESGGGLVQAGESRRLSCAVSGDTSKFKAVGWYRQAPG AQRELLAWINNSGVGNTAESVKGRFTISRDNAKNTVYLQMNR LTPEDTDVYYCRFYRRFGINKNYWGQGTQVTVSS |
| Exemplary anti-target (MSLN) (SEQ ID NO: 233) | QVQLVESGGGLVQAGGSLRLSCAASGSTFGNKPMGWYRQAP GKQRELVAVISSDGGSTRYAALVKGRFTISRDNAKNTVYLQME SLVAEDTAVYYCNALRTYYLNDPVVFSWGQGTQVTVSS |
| Exemplary anti-target (MSLN) (SEQ ID NO: 234) | QVQLVESGGGLVQAGGSLRLSCAASGSTSSINTMYWYRQAPG KERELVAFISSGGSTNVRDSVKGRFSVSRDSAKNIVYLQMNSLT PEDTAVYYCNTYIPLRGTLHDYWGQGTQVTVSS |
| Exemplary anti-target (MSLN) (SEQ ID NO: 235) | QVQLVESGGGLVQAGGSLRLSCVASGRTDRITTMGWYRQAP GKQRELVATISNRGTSNYANSVKGRFTISRDNAKNTVYLQMNS LKPEDTAVYYCNARKWGRNYWGQGTQVTVSS |

| SEQUENCE TABLE | |
|---|---|
| DESCRIPTION | SEQUENCE |
| Exemplary anti-target (MSLN) (SEQ ID NO: 236) | QVQLVESGGGLVQARGSLRLSCTASGRTIGINDMAWYRQAPG NQRELVATITKGGTTDYADSVDGRFTISRDNAKNTVYLQMNSL KPEDTAVYYCNTKRREWAKDFEYWGQGTQVTVSS |
| Exemplary anti-target (MSLN) (SEQ ID NO: 237) | QVQLVESGGGLVQAGGSLRLSCAASAIGSINSMSWYRQAPGK QREPVAVITDRGSTSYADSVKGRFTISRDNAKNTVYLQMNSLK PEDTAIYTCHVIADWRGYWGQGTQVTVSS |
| Exemplary anti-target (MSLN) (SEQ ID NO: 238) | QVQLVESGGGLVQAGGSLRLSCAASGSTSSINTMYWFRQAPG EERELVATINRGGSTNVRDSVKGRFSVSRDSAKNIVYLQMNRL KPEDTAVYYCNTYIPYGGTLHDFWGQGTQVTVSS |
| Exemplary anti-target (MSLN) (SEQ ID NO: 239) | QVQLVESGGGLVQAGGSLRLSCTTSTTFSINSMSWYRQAPGN QREPVAVITNRGTTSYADSVKGRFTISRDNARNTVYLQMDSLK PEDTAIYTCHVIADWRGYWGQGTQVTVSS |
| Exemplary anti-target (MSLN) (SEQ ID NO: 240) | QVQLVESGGGLVQAGGSLTLSCAASGSTFSIRAMRWYRQAPG TERDLVAVIYGSSTYYADAVKGRFTISRDNAKNTLYLQMNNLKP EDTAVYYCNADTIGTARDYWGQGTQVTVSS |
| Exemplary anti-target (MSLN) (SEQ ID NO: 241) | QVQLVESGGGLVQAGGSLRLSCVASGRTSTIDTMYWHRQAPG NERELVAYVTSRGTSNVADSVKGRFTISRDNAKNTAYLQMNSL KPEDTAVYYCSVRTTSYPVDFWGQGTQVTVSS |
| Exemplary anti-target (MSLN) (SEQ ID NO: 242) | QVQLVESGGGLVQAGGSLRLSCAASGSTSSINTMYWYRQAPG KERELVAFISSGGSTNVRDSVKGRFSVSRDSAKNIVYLQMNSLK PEDTAVYYCNTYIPYGGTLHDFWGQGTQVTVSS |
| Exemplary anti-target (MSLN) (SEQ ID NO: 243) | QVQLVESGGGLVQPGGSLRLSCAASGGDWSANFMYWYRQA PGKQRELVARISGRGVVDYVESVKGRFTISRDNAKNTVYLQMN SLKPEDTAVYYCAVASYWGQGTQVTVSS |
| Exemplary anti-target (MSLN) (SEQ ID NO: 244) | EVQLVESGGGLVQPGGSLRLSCAASGGDWSANFMYWYRQAP GKQRELVARISGRGVVDYVESVKGRFTISRDNSKNTLYLQMNSL RAEDTAVYYCAVASYWGQGTLVTVSS |
| Exemplary anti-target (MSLN) (SEQ ID NO: 245) | EVQLVESGGGLVQPGGSLRLSCAASGGDWSANFMYWVRQAP GKGLEWVSRISGRGVVDYVESVKGRFTISRDNSKNTLYLQMNS LRAEDTAVYYCAVASYWGQGTLVTVSS |
| Exemplary anti-target (MSLN) (SEQ ID NO: 246) | EVQLVESGGGLVQAGGSLRLSCAASGSTSSINTMYWYRQAPG KERELVAFISSGGSTNVRDSVKGRFTISRDNSKNTLYLQMNSLR AEDTAVYYCNTYIPYGGTLHDFWGQGTLVTVSS |
| Exemplary anti-target (MSLN) (SEQ ID NO: 247) | EVQLVESGGGLVQPGGSLRLSCAASGSTSSINTMYWYRQAPG KERELVAFISSGGSTNVRDSVKGRFTISRDNSKNTLYLQMNSLR AEDTAVYYCNTYIPYGGTLHDFWGQGTLVTVSS |
| Exemplary anti-target (MSLN) (SEQ ID NO: 248) | EVQLVESGGGLVQPGGSLRLSCAASGSTSSINTMYWVRQAPG KGLEWVSFISSGGSTNVRDSVKGRFTISRDNSKNTLYLQMNSLR AEDTAVYYCNTYIPYGGTLHDFWGQGTLVTVSS |
| Exemplary anti-target (MSLN) (SEQ ID NO: 249) | QVQLVESGGGVVQAGGSLRLSCAASGSTFSIRAMRWYRQAPG TERDLVAVIYGSSTYYADAVKGRFTISRDNSKNTLYLQMNSLRA EDTAVYYCNADTIGTARDYWGQGTLVTVSS |
| Exemplary anti-target (MSLN) (SEQ ID NO: 250) | QVQLVESGGGVVQPGGSLRLSCAASGSTFSIRAMRWYRQAPG KERELVAVIYGSSTYYADAVKGRFTISRDNSKNTLYLQMNSLRA EDTAVYYCNADTIGTARDYWGQGTLVTVSSGG |
| Exemplary anti-target (MSLN) (SEQ ID NO: 251) | QVQLVESGGGVVQPGGSLRLSCAASGSTFSIRAMRWVRQAPG KGLEWVSVIYGSSTYYADAVKGRFTISRDNSKNTLYLQMNSLRA EDTAVYYCNADTIGTARDYWGQGTLVTVSSGG |
| Exemplary anti-target (MSLN) (SEQ ID NO: 252) | EVQLVESGGGLVQAGGSLRLSCVASGRTSTIDTMYWHRQAPG NERELVAYVTSRGTSNVADSVKGRFTISRDNSKNTLYLQMNSL RAEDTAVYYCSVRTTSYPVDFWGQGTLVTVSGG |
| Exemplary anti-target (MSLN) (SEQ ID NO: 253) | EVQLVESGGGLVQPGGSLRLSCAASGRTSTIDTMYWHRQAPG KERELVAYVTSRGTSNVADSVKGRFTISRDNSKNTLYLQMNSLR AEDTAVYYCSVRTTSYPVDFWGQGTLVTVSS |

SEQUENCE TABLE

| DESCRIPTION | SEQUENCE |
|---|---|
| Exemplary anti-target (MSLN) (SEQ ID NO: 254) | EVQLVESGGGLVQPGGSLRLSCAASGRTSTIDTMYWVRQAPG KGLEWVSYVTSRGTSNVADSVKGRFTISRDNSKNTLYLQMNSL RAEDTAVYYCSVRTTSYPVDFWGQGTLVTVSS |
| Exemplary anti-target (MSLN) (SEQ ID NO: 255) | QVQLVESGGGVVQAGGSLTLSCAASGSTFSIRAMRWYRQAPG TERDLVAVIYGSSTYYADAVKGRFTISRDNSKNTLYLQMNSLRA EDTAVYYCNADTIGTARDYWGQGTLVTVSS |
| Exemplary anti-target (MSLN) (SEQ ID NO: 256) | QVQLVESGGGVVQAGGSLRLSCAASGSTFSIRAMRWYRQAPG TERDLVAVIYGSSTYYADAVKGRFTISRDNSKNTLYLQMNSLRA EDTAVYYCNADTIGTARDYWGQGTLVTVSS |
| Exemplary anti-target (MSLN) (SEQ ID NO: 257) | QVQLVESGGGVVQPGGSLRLSCAASGSTFSIRAMRWYRQAPG KERELVAVIYGSSTYYADAVKGRFTISRDNSKNTLYLQMNSLRA EDTAVYYCNADTIGTARDYWGQGTLVTVSS |
| Exemplary anti-target (MSLN) (SEQ ID NO: 258) | QVQLVESGGGVVQPGGSLRLSCAASGSTFSIRAMRWVRQAPG KGLEWVSVIYGSSTYYADAVKGRFTISRDNSKNTLYLQMNSLRA EDTAVYYCNADTIGTARDYWGQGTLVTVSS |
| Exemplary anti-target (DLL3) (SEQ ID NO: 306) | QVQLQESGGGLVQAGGSLRLSCAASGSIFSIASMGWYRQAPG KQRELVAVITSFSSTNYADSVKGRFTISRDNAKNTVYLQMNSLK PEDTGVYYCNARYFERTDWGQGTQVTVSS |
| Exemplary anti-target (DLL3) (SEQ ID NO: 307) | QVQLQESGGGLVQAGGSLRLSCAAPGSIFSIASMGWYRQAPG KQRELVAVITSFSSTNYADSVKGRFTISRDNAKNTVYLQMNSLK PEDTGVYYCNARYFERTDWGQGTQVTVSS |
| Exemplary anti-target (DLL3) (SEQ ID NO: 308) | QVQLQESGGGLVQAGGSLRLSCAASGSIFSIASMAWYRQAPG KQRELVAAITSFSSTNYADSVKGRFTISRDNAKNTVYLQMNSLK PEDTGVYYCNARYFERTDWGQGTQVTVSS |
| Exemplary anti-target (DLL3) (SEQ ID NO: 309) | QVQLQESGGGLVQAGGSLRLSCAASESIFSINVMAWHRQAPG KQRELVARITSGGSTNYADSVKGRFTISRDNAKNTVYLQMNSL KPEDTGVYYCGAYQGLYAYWGQGTQVTVSS |
| Exemplary anti-target (DLL3) (SEQ ID NO: 310) | QVQLQESGGGLVQAGGSLRLSCVASGSSFSITSMAWYRQAPG KQRDLVAAITSFGSTNYADSVKDRFTISRDNAKNTVYLQMNSL KPEDTAVYYCNGRVFDHVYWGQGTQVTVSS |
| Exemplary anti-target (DLL3) (SEQ ID NO: 311) | QVQLQESGGGLVQAGGSLKLSCAASSSIFSISSMSWYRQAPGK QRELVAAITTFDYTNYADSVKGRFTISRDNAKNMMYLQMNSL KPEDTAVYLCNARAFGRDYWGQGTQVTVSS |
| Exemplary anti-target (DLL3) (SEQ ID NO: 312) | QVQLQESGGGLVQAGGSLKLSCAASSSIFSISSMSWYRQAPGK QRELVAAITSFGSTNYADSVKGRFTISRDNAKNMMYLQMNSL KPEDTAVYRCNARTMGRDYWGQGTQVTVSS |
| Exemplary anti-target (DLL3) (SEQ ID NO: 313) | QVQLQESGGGLVQPGGSLRLSCAASGSTLNIKIMAWHRQAPG KQRELVATLTSGGNTNYADSVKGRFTISRDNAKNTVYLQMNSL QPEDTAVYYCGLWDGVGGAYWGRGTQVTVSS |
| Exemplary anti-target (DLL3) (SEQ ID NO: 314) | QVQLQESGGGLVQPGGSLRISCAASGSTLNIKIMAWHRQAPG KQRELVATLTSGGNTNYADSVKGRFTISRDNAKNTVYLQMNSL QPEDTAVYYCGLWDGVGGAYWGRGTQVTVSS |
| Exemplary anti-target (DLL3) (SEQ ID NO: 315) | QVQLQESGGGLVQAGGSLRLSCAASGSTFNIKTMAWHRQAP GNQRELVATLTSGGNTNYADSVKGRFTISRDNAKNTVYLQMN SLKPEDTAVYYCGLWNGVGGAYWGRGTQVTVSS |
| Exemplary anti-target (DLL3) (SEQ ID NO: 316) | QVQLQDGGGLVQPGGSLRLSCAASGSTFNIKLMAWHRQAPG NQRELVATLTSGGNTNYADSVKGRFTISRDNASNIVYLQMNSL KPEDTAVYYCGLWDGVGGAYWGRGTQVTVSS |
| Exemplary anti-target (DLL3) (SEQ ID NO: 317) | QVQLQESGGGLVQAGGSLRLSCAASGSTFNFKIMAWHRQAP GKQRELVASLTSEGLTNYRDSVKGRFTISRDNAKNTVYLQMNN LKPEDTAVYYCGLWDGVGGAYWGRGTQVTVSS |
| Exemplary anti-target (DLL3) (SEQ ID NO: 318) | QVQLQESGGGLVQPGGSLRLSCAASGFMFSSYSMSWYRQAP GKQRELVAAITTWGSTNYADSVKGRFTISRDNAKNTVWLQM NSLEPEDTAVYFCNARSWNNYWGQGTQVTVSS |

| SEQUENCE TABLE | |
|---|---|
| DESCRIPTION | SEQUENCE |
| Exemplary anti-target (DLL3) (SEQ ID NO: 319) | QVQLQESGGGLVQVGGSLRLSCAASGFMFSSYSMSWYRQAP GKQRELVAAITSYGSTNYADSVKGRFTISRDNAKNTVWLQMN SLKPEDTAVYFCNARSWNNYWGQGTQVTVSS |
| Exemplary anti-target (DLL3) (SEQ ID NO: 320) | QVQLQESGGGLVQPGGSLRLSCAASGFTFSSHSMSWYRQAPG KQRELVAAITTYGSTNYIDSVKGRFTISRDNTKNTVYLQMNSLK PEDTAVYFCNARSWNNYWGQGTQVTVSS |
| Exemplary anti-target (DLL3) (SEQ ID NO: 321) | QVQLQESGGGLVQAGGSLRLSCVASGSSFSHNTMGWYRQAP GKQRDLVARITTFGTTNYADSVKGRFTISRDNAKNTVYLQMNS LKPEDTAVYYCNGESFGRIWYNWGQGTQVTVSS |
| Exemplary anti-target (DLL3) (SEQ ID NO: 322) | QVQLQESGGGLVQAGASLRLTCTASGGRFSYATMGWSRQAP GKQREMVARITSSGFSTNYADSVKGRFTISRDNAKNAVYLQM DSLKPEDTAVYYCNAQHFGTDSWGQGTQVTVSS |
| Exemplary anti-target (DLL3) (SEQ ID NO: 323) | QVQLQESGGGLVQAGASLRLTCTASGSRFSYATMGWSRQAP GKQRELVARITSSGFSTNYADSVKGRFTISRDNAKNAVYLQMD SLKPEDTAVYYCNAQQFGTDSWGQGTQVTVSS |
| Exemplary anti-target (DLL3) (SEQ ID NO: 324) | QVQLQESGGGLVQAGGSLRLSCAASGSTFTSNVMGWHRQAP GKQRELVANMHSGGSTNYADSVKGRFTISRDNAKNIVYLQMN NLKIEDTAVYYCRWYGIQRAEGYWGQGTQVTVSS |
| Exemplary anti-target (DLL3) (SEQ ID NO: 325) | QVQLQESGGGLVVAGGSLRLSCAASGSSVSFLSMAWYRQAPG KKRELVAGISVDGSTNYADSVKGRFTVSRDNAKNTVYLQMNSL QPEDTAVYYCYAYRWVGRDTYWGQGTQVTVSS |
| Exemplary anti-target (DLL3) (SEQ ID NO: 326) | QVQLQESGGGLVVAGGSLRLSCAASGSSVSFLSMAWYRQAPG KKRELVAGISVDGSTNYADSVKGRFTISRDNAKNTVYLQMNSL QPEDTAVYYCYAYRWVGRDTYWGQGTQVTVSS |
| Exemplary anti-target (DLL3) (SEQ ID NO: 327) | QVQLQESGGGLVVSGGSLRLSCAASGSSVSFLSMAWYRQAPG KKRELVAGISVDGSTNYADSVKGRFTISRDNAKNTVYLQMNSL QPEDTAAYYCYAYRWVGRDTYWGQGTQVTVSS |
| Exemplary anti-target (DLL3) (SEQ ID NO: 328) | QVQLQESGGGLVVAGGSLRLSCAASGSSVSFLSMAWYRQAPG KKRELVAGISVDGSTNYADSVKGRFTISRDNAENTVYLQMNSL QPEDTAVYYCYAYRWEGRDTYWGQGTQVTVSS |
| Exemplary anti-target (DLL3) (SEQ ID NO: 329) | QVQLQESGGGLVVAGGSLRLSCAASGSSVSFLSMAWYRQAPG KKRELVAGISVDGSTNYADSVKGRFTISRDNAENTVYLQMNSL QPEDTAVYYCYAYRWEGRNTYWGQGTQVTVSS |
| Exemplary anti-target (DLL3) (SEQ ID NO: 330) | QVQLQESGGGLVQPGGSLRLSCAASGSSVSFLSMAWYRQAPG KKRELVAGISTDGSTNYVDSVKGRFTISRDNAKNTVYLQMNSL QPEDTAVYYCYAYRWVGRYTYWGQGTQVTVSS |
| Exemplary anti-target (DLL3) (SEQ ID NO: 331) | QVQLQESGGGLVVAGGSLRLSCAASGSSVSFLSMAWYRQAPG KKRELVAGISTDGTTNYVDSVKDRFTISRDNAKNTVYLQMNSL QPEDTAAYYCYAYRWVGRDTYWGQGTQVTVSS |
| Exemplary anti-target (DLL3) (SEQ ID NO: 332) | QVQLQESGGGLVVAGGSLRLSCAASGSSVSFLSIAWYRQAPGK KRELVAGISTDGTTNYVDSVKDRFTISRDNAKNTVYLQMNSLQ PEDTAAYYCYAYRWVGRDTYWGQGTQVTVSS |
| Exemplary anti-target (DLL3) (SEQ ID NO: 333) | QVQLQESGGGLVQAGGSLTLSCAASGSSVSFLSMAWYRQAPG KKRELVAGISTDGTTNYVDSVKDRFTISRDNAKNTVYLQMNSL QPEDTAAYYCYAYRWVGRDTYWGQGTQVTVSS |
| Exemplary anti-target (DLL3) (SEQ ID NO: 334) | QVQLQESGGGLVQAGGSLRLSCAASGSSVSFLSMAWYRQAPG KKRELVAGISTDGSTNYADSVKGRFTISEGNAKNTVDLQMNSL QPEDTAVYYCYAYRWVDRYTYWGQGTQVTVSS |
| Exemplary anti-target (DLL3) (SEQ ID NO: 335) | QVQLQESGGGLVVAGGSLRLSCAASGSSVSFLSMAWYRQAPG KKRELVAGISTDGSTNYADSVKGRFTISEDNAKNTVDLQMNSL QPEDTAVYYCYAYRWIDRYTYWGQGTQVTVSS |
| Exemplary anti-target (DLL3) (SEQ ID NO: 336) | QVQLQESGGGLVQPGGSLRLSCAASGSSVSFLSMAWYRQAPG KKRELVAGISTDGSTNYADSVKGRFTISEDNAKNTVDLQMNSL QPEDTAVYYCYAYRWVDRYTYWGQGTQVTVSS |

| SEQUENCE TABLE | |
|---|---|
| DESCRIPTION | SEQUENCE |
| Exemplary anti-target (DLL3)<br>(SEQ ID NO: 337) | QVQLQESGGGLVVAGGSLRLSCAASGSSVSFLSMAWYRQAPG<br>KKRELVAGISSDGSTNYVDSVKGRFTISRDNAKNIVFLQMNSLQ<br>PQDTAVYYCYAYRWVGRDTYWGQGTQVTVSS |
| Exemplary anti-target (DLL3)<br>(SEQ ID NO: 338) | QVQLQESGGGLVVAGGSLRLSCAASGSSVSFLSMAWYRQAPG<br>KKRELVAGISADGSTDYIDSVKGRFTISRDSANNTMYLQMNSL<br>QPEDTAVYYCYAYRWTTRYTYWGQGTQVTVSS |
| Exemplary anti-target (DLL3)<br>(SEQ ID NO: 339) | QVQLQESGGGLVQPGGSLRLSCAASGFTLDYYAIGWYRQAPG<br>KKRELVAGISSDGSTHYVDSVKGRFAISRDNAENTVYLQMNDL<br>QPDDTAVYYCYAYRWVGGYTYWGQGTQVTVSS |
| Exemplary anti-target (DLL3)<br>(SEQ ID NO: 340) | QVQLQESGGGLVQAGGSLRLSCVASGSTSSINAMGWYRRAPG<br>KQRELVAGISSDGSKNYADSVKGRFTISRDNAKNTVYLQMNSL<br>KPEDTAVYYCYYFRTVAASSMQYWGQGTQVTVSS |
| Exemplary anti-target (DLL3)<br>(SEQ ID NO: 341) | QVQLQESGGGLVQAGGSLRLSCVASGSTSSINAMGWYRRAPG<br>KQRELVAGISSDGSKVYADSVKGRFTISRDNAKNTVYLQMNSL<br>KPEDTAVFYCYYFRTVSGSSMRYWGQGTQVTVSS |
| Exemplary anti-target (DLL3)<br>(SEQ ID NO: 342) | QVQLQESGGGLVQAGGSLRLSCAASGITSSVYSMGWYRQAPG<br>KQRELVAGSSSDGSTHYVDSVRGRFTISRDNAKNTVYLQMSSL<br>KPEDTAVYYCYANRGFAGAPSYWGQGTQVTVSS |
| Exemplary anti-target (DLL3)<br>(SEQ ID NO: 343) | QVQLQESGGGLVQAGGSLRLSCAASGRTSMFNSMGWHRQA<br>PGKQRELVAIIRSGGSNYADTVKGRFTISRDNTKNTVYLQMN<br>DLKPEDTAVYYCFYYFQSSYWGQGTQVTVSS |
| Exemplary anti-target (DLL3)<br>(SEQ ID NO: 344) | QVQLQESGGGLVQAGGSLRLSCAASGRTSMVNSMGWHRQA<br>PGKQRELVALITSGGSNYADTVKGRFTISRDNTKNTVYLQMN<br>DLKPEDTAVYYCFYYFQSSYWGQGTQVTVSS |
| Exemplary anti-target (DLL3)<br>(SEQ ID NO: 910) | QVQLQESGGGLVQAGGSLRLSCAASGSVSMFNSMGWHRQP<br>PGKQRELVAIITSGGSNYADTVKGRFTISRDNTKNTVYLQMN<br>DLKPEDTAVYYCFYYFQSSYWGQGTQVTVSS |
| Exemplary anti-target (DLL3)<br>(SEQ ID NO: 345) | QVQLQESGGGLVQAGGSLRLSCTASGSIFSIAVMGWYRQVPG<br>KRREWVATIFDGSYTNYADSVKGRFTISRDNARNKVYLQMNN<br>LKPEDTAVYYCQTHWTQGSVPKESWGQGTQVTVSS |
| Exemplary anti-target (DLL3)<br>(SEQ ID NO: 346) | QVQLQESGGGLVQAGGSLRLSCVASSGIFSDMSMVWYRQAP<br>GKQRELVASITTFGSTNYADPVKGRFTISRDNAKNTVYLQMNSL<br>KPEDTAVYYCSGRSYSSDYWGRGTQVTVSS |
| Exemplary anti-target (DLL3)<br>(SEQ ID NO: 347) | QVQLQESGGGLVQAGGSLRLSCVASGSISSIIVMGWSRQAPGK<br>QRESVATITRDGTRNYADSLKGRFTISRDNAKNTSYLQINSLKPE<br>DTAVYSCYARYGDINYWGKGTQVTVSS |
| Exemplary anti-target (DLL3)<br>(SEQ ID NO: 348) | QVQLQESGGGLVQAGGSLRLSCVASGSISSIIVMGWSRQAPGK<br>QRESLATISRGGTRTYADSVKGRFTISRDNAKNTSYLQMNSLKP<br>EDTAVYSCYARYGDINYWGKGTQVTVSS |
| Exemplary anti-target (DLL3)<br>(SEQ ID NO: 349) | QVQLQESGGGLVQAGGSLRLSCVASGSIFTTNSMGWHRQGP<br>GKQRELVALIGSAGSTKYADSVKGRFTISRDNAKNTVSLQMDSL<br>KPEDTAVYYCFYYDSRSYWGQGTQVTVSS |
| Exemplary anti-target (DLL3)<br>(SEQ ID NO: 350) | QVQLQESGGGMVQPGGSLRLSCAASGSREISTMGWHRQAPG<br>KQRELAARITSGGITKYADSVKGRFTISRDNAKKTVYLQMNSLK<br>SEDTAVYYCFAYDNINAYWGQGTQVTVSS |
| Exemplary anti-target (DLL3)<br>(SEQ ID NO: 351) | QVQLQESGGGWVQAGGSLRLSCAASGSREISTMGWHRQAP<br>GKQRELAARITSGGITKYADSVKGRFTISRDNAKKTVYLQMNSL<br>KSEDTAVYYCFAYDNINAYWGQGTQVTVSS |
| Exemplary anti-target (DLL3)<br>(SEQ ID NO: 352) | QVQLQESGGGWVQAGGSLRLSCTASGSREISTMGWHRQAPG<br>KQRELAARITSGGITKYADSVKGRFTISRDNAKKTVYLQMDSLK<br>SEDTAVYYCFAYDNINAYWGQGTQVTVSS |
| Exemplary anti-target (DLL3)<br>(SEQ ID NO: 353) | QVQLQESGGGSVQAGRSLGLSCAASGSREISTMGWHRQAPG<br>KQRELAARITSGGITKYADSVKGRFTISRDNAKKTVYLQMNSLK<br>SEDTAVYYCFAYDNINAYWGQGTQVTVSS |

| SEQUENCE TABLE | |
|---|---|
| DESCRIPTION | SEQUENCE |
| Exemplary anti-target (DLL3) (SEQ ID NO: 354) | QVQLQESGGGLVQAGGSLRLSCTASGSIFRGAAMYWHRQAP GKQRELVAAITTSGNTSYADSVKGRFTISRDNAKNTMYLQIISLK PEDTAVYYCAFWIAGKAYWGQGTQVTVSS |
| Exemplary anti-target (DLL3) (SEQ ID NO: 355) | QVQLQESGGGLVQPGGSLRLSCAASGSISSFNFMSWHRQAPG KERELAGVITRGGATNYADSVKGRFTISRDNVKNTVYLQMNGL KPEDTAVYYCHGRSQLGSTWGQGTQVTVSS |
| Exemplary anti-target (DLL3) (SEQ ID NO: 356) | QVQLQESGGGLVQAGGSLRLSCLASGTIFTASTMGWHRQPPG KQRELVASIAGDGRTNYAESTEGRFTISRDDAKNTMYLQMNSL KPEDTAVYYCYAYYLDTYAYWGQGTQVTVSS |
| Exemplary anti-target (DLL3) (SEQ ID NO: 357) | EVQLVESGGGLVQPGGSLTLSCAASGSIFSIASMGWYRQAPGK QRELVAVITSFSSTNYADSVKGRFTISRDNAKNSVYLQMNSLRA EDTAVYYCNARYFERTDWGQGTLVTVSS |
| Exemplary anti-target (DLL3) (SEQ ID NO: 358) | EVQLVESGGGLVQPGGSLTLSCAASGRTSMFNSMGWHRQAP GKQRELVAIIRSGGSSNYADTVKGRFTISRDNAKNSVYLQMNSL RAEDTAVYYCFYFQSSYWGQGTLVTVSS |
| Exemplary anti-target (DLL3) (SEQ ID NO: 359) | EVQLVESGGGLVQPGGSLTLSCAASGSVSFLSMAWYRQAPG KKRELVAGISVDGSTNYADSVKGRFTISRDNAKNSVYLQMNSL RAEDTAVYYCYAYRWVGRDTYWGQGTLVTVSS |
| Exemplary anti-target (DLL3) (SEQ ID NO: 360) | EVQLVESGGGLVQPGGSLTLSCTASGSIFRGAAMYWHRQAPG KQRELVAAITTSGNTSYADSVKGRFTISRDNAKNSMYLQMNSL RAEDTAVYYCAFWIAGKAYWGQGTLVTVSS |
| Exemplary anti-target (DLL3) (SEQ ID NO: 361) | EVQLVESGGGLVQPGGSLTLSCAASGSTFNIKTMAWHRQAPG NQRELVATLTSGGNTNYADSVKGRFTISRDNAKNSVYLQMNSL RAEDTAVYYCGLWNGVGGAYWGQGTLVTVSS |
| Exemplary anti-target (DLL3) (SEQ ID NO: 362) | EVQLVESGGGLVQPGGSLTLSCAASGSTLNIKIMAWHRQAPGK QRELVATLTSGGNTNYADSVKGRFTISRDNAKNSVYLQMNSLR AEDTAVYYCGLWDGVGGAYWGQGTLVTVSS |
| Exemplary anti-target (DLL3) (SEQ ID NO: 363) | EVQLVESGGGLVQPGGSLTLSCAASSIFSISSMSWYRQAPGK QRELVAAITTFDYTNYADSVKGRFTISRDNAKNSMYLQMNSLR AEDTAVYYCNARAFGRDYWGQGTLVTVSS |
| Exemplary anti-target (DLL3) (SEQ ID NO: 364) | EVQLVESGGGLVQPGGSLTLSCVASGSTSSINAMGWYRRAPG KQRELVAGISSDGSKNYADSVKGRFTISRDNAKNSVYLQMNSL RAEDTAVYYCYYFRTVAASSMQYWGQGTLVTVSS |
| Exemplary anti-target (DLL3) (SEQ ID NO: 365) | EVQLVESGGGLVQPGGSLTLSCAASGFMFSSYSMSWYRQAPG KQRELVAAITSYGSTNYADSVKGRFTISRDNAKNSVYLQMNSLR AEDTAVYYCNARSWNNYWGQGTLVTVSS |
| Exemplary anti-target (DLL3) (SEQ ID NO: 366) | EVQLVESGGGLVQPGGSLTLSCAASGSVSMFNSMGWHRQPP GKQRELVAIITSGGSSNYADTVKGRFTISRDNAKNSVYLQMNSL RAEDTAVYYCFYFQSSYWGQGTLVTVSS |
| Exemplary anti-target (DLL3) (SEQ ID NO: 367) | EVQLVESGGGLVQPGGSLTLSCTASGGRFSYATMGWSRQAPG KQREMVARITSSGFSTNYADSVKGRFTISRDNAKNSVYLQMNS LRAEDTAVYYCNAQHFGTDSWGQGTLVTVSS |
| Exemplary anti-target (DLL3) (SEQ ID NO: 368) | EVQLVESGGGLVQPGGSLTLSCAASGSISSFNFMSWHRQAPG KERELAGVITRGGATNYADSVKGRFTISRDNAKNSVYLQMNSL RAEDTAVYYCHGRSQLGSTWGQGTLVTVSS |
| Exemplary anti-target (DLL3) (SEQ ID NO: 369) | EVQLVESGGGLVQPGGSLTLSCAASESIFSINVMAWHRQAPGK QRELVARITSGGSTNYADSVKGRFTISRDNAKNSVYLQMNSLR AEDTAVYYCGAYQGLYAYWGQGTLVTVSS |
| Exemplary anti-target (DLL3) (SEQ ID NO: 370) | EVQLVESGGGLVQPGGSLTLSCAASGSREISTMGWHRQAPGK QRELAARITSGGITKYADSVKGRFTISRDNAKNSVYLQMNSLRA EDTAVYYCFAYDNINAYWGQGTLVTVSS |
| Exemplary anti-target (DLL3) (SEQ ID NO: 371) | EVQLVESGGGLVQPGGSLTLSCTASGSIFSIAVMGWYRQVPGK RREWVATIFDGSYTNYADSVKGRFTISRDNAKNSVYLQMNSLR AEDTAVYYCQTHWTQGSVPKESWGQGTLVTVSS |

| SEQUENCE TABLE | |
|---|---|
| DESCRIPTION | SEQUENCE |
| Exemplary anti-target (DLL3) (SEQ ID NO: 372) | EVQLVESGGGLVQPGGSLTLSCVASGSTSSINAMGWYRRAPG KQRELVAGISSDGSKVYADSVKGRFTISRDNAKNSVYLQMNSL RAEDTAVYYCYYFRTVSGSSMRYWGQGTLVTVSS |
| Exemplary anti-target (DLL3) (SEQ ID NO: 373) | EVQLVESGGGLVQPGGSLTLSCVASSGIFSDMSMVWYRQAPG KQRELVASITTFGSTNYADPVKGRFTISRDNAKNSVYLQMNSLR AEDTAVYYCSGRSYSSDYWGQGTLVTVSS |
| Exemplary anti-target (DLL3) (SEQ ID NO: 374) | EVQLVESGGGLVQPGGSLTLSCAASGFMFSSYSMSWYRQAPG KQRELVAAITTWGSTNYADSVKGRFTISRDNAKNSVYLQMNSL RAEDTAVYYCNARSWNNYWGQGTLVTVSS |
| Exemplary anti-target (DLL3) (SEQ ID NO: 375) | EVQLVESGGGLVQPGGSLTLSCTASGSRFSYATMGWSRQAPG KQRELVARITSSGFSTNYADSVKGRFTISRDNAKNSVYLQMNSL RAEDTAVYYCNAQQFGTDSWGQGTLVTVSS |
| Exemplary anti-target (DLL3) (SEQ ID NO: 376) | EVQLVESGGGLVQPGGSLTLSCAASGSTFTSNVMGWHRQAP GKQRELVANMHSGGSTNYADSVKGRFTISRDNAKNSVYLQM NSLRAEDTAVYYCRWYGIQRAEGYWGQGTLVTVSS |
| Exemplary anti-target (DLL3) (SEQ ID NO: 377) | EVQLVESGGGLVQPGGSLTLSCAASGSSVSFLSMAWYRQAPG KKRELVAGISTDGSTNYVDSVKGRFTISRDNAKNSVYLQMNSLR AEDTAVYYCYAYRWVGRYTYWGQGTLVTVSS |
| Exemplary anti-target (DLL3) (SEQ ID NO: 378) | EVQLVESGGGLVQPGGSLTLSCVASGSISSIIVMGWSRQAPGK QRESVATITRDGTRNYADSLKGRFTISRDNAKNSSYLQMNSLRA EDTAVYYCYARYGDINYWGQGTLVTVSS |
| Exemplary anti-target (DLL3) (SEQ ID NO: 379) | EVQLVESGGGLVQPGGSLTLSCAASGSSVSFLSMAWYRQAPG KKRELVAGISADGSTDYIDSVKGRFTISRDNAKNSVYLQMNSLR AEDTAVYYCYAYRWTTRYTYWGQGTLVTVSS |
| Exemplary anti-target (DLL3) (SEQ ID NO: 380) | EVQLVESGGGLVQPGGSLTLSCLASGTIFTASTMGWHRQPPGK QRELVASIAGDGRTNYAESTEGRFTISRDNAKNSMYLQMNSLR AEDTAVYYCYAYYLDTYAYWGQGTLVTVSS |
| Exemplary anti-target (DLL3) (SEQ ID NO: 381) | EVQLVESGGGLVQPGGSLTLSCAASGSSVSFLSMAWYRQAPG KKRELVAGISVDGSTNYADSVKGRFTISRDNAKNSVYLQMNSL RAEDTAVYYCYAYRWEGRNTYWGQGTLVTVSS |
| Exemplary anti-target (DLL3) (SEQ ID NO: 382) | EVQLVESGGGLVQPGGSLTLSCVASGSSFSHNTMGWYRQAPG KQRDLVARITTFGTTNYADSVKGRFTISRDNAKNSVYLQMNSL RAEDTAVYYCNGESFGRIWYNWGQGTLVTVSS |
| Exemplary anti-target (DLL3) (SEQ ID NO: 383) | EVQLVESGGGLVQPGGSLTLSCVASGSISSIIVMGWSRQAPGK QRESLATISRGGTRTYADSVKGRFTISRDNAKNSSYLQMNSLRA EDTAVYYCYARYGDINYWGQGTLVTVSS |
| Exemplary anti-target (DLL3) (SEQ ID NO: 384) | EVQLVESGGGLVQPGGSLTLSCVASGSSFSITSMAWYRQAPGK QRDLVAAITSFGSTNYADSVKDRFTISRDNAKNSVYLQMNSLR AEDTAVYYCNGRVFDHVYWGQGTLVTVSS |
| Exemplary anti-target (DLL3) (SEQ ID NO: 385) | EVQLVESGGGLVQPGGSLTLSCAASGRTSMVNSMGWHRQAP GKQRELVALITSGGSSNYADTVKGRFTISRDNAKNSVYLQMNS LRAEDTAVYYCFYYFQSSYWGQGTLVTVSS |
| Exemplary anti-target (DLL3) (SEQ ID NO: 386) | EVQLVESGGGLVQPGGSLTLSCAASGSTFNFKIMAWHRQAPG KQRELVASLTSEGLTNYRDSVKGRFTISRDNAKNSVYLQMNSLR AEDTAVYYCGLWDGVGGAYWGQGTLVTVSS |
| Exemplary anti-target (DLL3) (SEQ ID NO: 387) | EVQLVESGGGLVQPGGSLTLSCAASGFTLDYYAIGWYRQAPGK KRELVAGISSDGSTHYVDSVKGRFTISRDNAKNSVYLQMNSLRA EDTAVYYCYAYRWVGGYTYWGQGTLVTVSS |
| Exemplary anti-target (DLL3) (SEQ ID NO: 388) | EVQLVESGGGLVQPGGSLTLSCVASGSIFTTNSMGWHRQGPG KQRELVALIGSAGSTKYADSVKGRFTISRDNAKNSVYLQMNSLR AEDTAVYYCFYYDSRSYWGQGTLVTVSS |
| Exemplary anti-target (DLL3) (SEQ ID NO: 389) | EVQLVESGGGLVQPGGSLTLSCAASGITSSVYSMGWYRQAPG KQRELVAGSSSDGSTHYVDSVRGRFTISRDNAKNSVYLQMNSL RAEDTAVYYCYANRGFAGAPSYWGQGTLVTVSS |

| SEQUENCE TABLE | |
|---|---|
| DESCRIPTION | SEQUENCE |
| Exemplary anti-target (DLL3) (SEQ ID NO: 390) | EVQLVESGGGLVQPGGSLTLSCAASSSIFSISSMSWYRQAPGK QRELVAAITSFGSTNYADSVKGRFTISRDNAKNSMYLQMNSLR AEDTAVYYCNARTMGRDYWGQGTLVTVSS |
| Exemplary anti-target (DLL3) (SEQ ID NO: 391) | EVQLVESGGGLVQPGGSLTLSCVASGFTSSINAMGWYRRAPG KQRELVAGISSDGSFVYADSVKGRFTISRDNAKNSVYLQMNSLR AEDTAVYYCYYFRHVSGSSMRYWGQGTLVTVSS |
| Exemplary anti-target (DLL3) (SEQ ID NO: 392) | EVQLVESGGGLVQPGGSLTLSCVASGSTSSINAMAWYRRAPG KQRELVAGISSDGSKVYADSVKGRFTISRDNAKNSVYLQMNSL RAEDTAVYYCYYFRTVSGSSSRYWGQGTLVTVSS |
| Exemplary anti-target (DLL3) (SEQ ID NO: 393) | EVQLVESGGGLVQPGGSLTLSCVASGSTSSINAMGWYRRAPG KQRELVAGISSDGSKVYEDSVKGRFTISRDNAKNSVYLQMNSLR AEDTAVYYCYYFRTVSGSSMRYWGQGTLVTVSS |
| Exemplary anti-target (DLL3) (SEQ ID NO: 394) | EVQLVESGGGLVQPGGSLTLSCVASGSPSSINAMGWYRRAPG KQRELSAGISSDGSKVYADSVKGRFTISRDNAKNSVYLQMNSLR AEDTAVYYCYYFRTVRGSSMSYWGQGTLVTVSS |
| Exemplary anti-target (DLL3) (SEQ ID NO: 395) | EVQLVESGGGLVQPGGSLTLSCVASGSTSSINAMGWYRRAPG KQRELAAGISSDGSSVYADSVKGRFTISRDNAKNSVYLQMNSLR AEDTAVYYCYYFRTVSGSSKRYWGQGTLVTVSS |
| Exemplary anti-target (DLL3) (SEQ ID NO: 396) | EVQLVESGGGLVQPGGSLTLSCVASGSISSINAMGWYRRAPGK QRELVAGISSDGSKVYADSVKGRFTISRDNAKNSVYLQMNSLR AEDTAVYYCYYFRMVSGSSMRYWGQGTLVTVSS |
| Exemplary anti-target (DLL3) (SEQ ID NO: 397) | EVQLVESGGGLVQPGGSLTLSCVASGSTSSINAMAWYRRAPG KQRELVAGISSDGSKLYADSVKGRFTISRDNAKNSVYLQMNSLR AEDTAVYYCYYFRTVQGSSMRYWGQGTLVTVSS |
| Exemplary anti-target (DLL3) (SEQ ID NO: 398) | EVQLVESGGGLVQPGGSLTLSCVASGSTSSINAYGWYRRAPGK QRELVAGISSDGSKVYADSVKGRFTISRDNAKNSVYLQMNSLR AEDTAVYYCYYFRTVYGSSMRYWGQGTLVTVSS |
| Exemplary anti-target (DLL3) (SEQ ID NO: 399) | EVQLVESGGGLVQPGGSLTLSCVASGSTSSINAIGWYRRAPGK QRELVAGISSDGSKVYIDSVKGRFTISRDNAKNSVYLQMNSLRA EDTAVYYCYYFRTVSGSSYRYWGQGTLVTVSS |
| Exemplary anti-target (DLL3) (SEQ ID NO: 400) | EVQLVESGGGLVQPGGSLTLSCVASGSTSSINAMAWYRRAPG KQRELVAGISSDGSKVYSDSVKGRFTISRDNAKNSVYLQMNSLR AEDTAVYYCYYFRTVLGSSMRYWGQGTLVTVSS |
| Exemplary anti-target (DLL3) (SEQ ID NO: 401) | EVQLVESGGGLVQPGGSLTLSCVASGSTSIINAMGWYRRAPGK QRELAAGISSDGSKVIADSVKGRFTISRDNAKNSVYLQMNSLRA EDTAVYYCYYFRRVSGSSMRYWGQGTLVTVSS |
| Exemplary anti-target (DLL3) (SEQ ID NO: 402) | EVQLVESGGGLVQPGGSLTLSCVASGSTSSINAMGWYRRAPG KQRELVAGISSDGSKIYADSVKGRFTISRDNAKNSVYLQMNSLR AEDTAVYYCYYFRTVSGSSMRYWGQGTLVTVSS |
| Exemplary anti-target (DLL3) (SEQ ID NO: 403) | EVQLVESGGGLVQPGGSLTLSCVASGKTSSINAMAWYRRAPG KQRELVAGISSDGSKVYTDSVKGRFTISRDNAKNSVYLQMNSLR AEDTAVYYCYYFRTVSGSSARYWGQGTLVTVSS |
| Exemplary anti-target (DLL3) (SEQ ID NO: 404) | EVQLVESGGGLVQPGGSLTLSCVASGTTSSINAMGWYRRAPG KQRELVAGISSDGSLVYADSVKGRFTISRDNAKNSVYLQMNSLR AEDTAVYYCYYFRIVRGSSMRYWGQGTLVTVSS |
| Exemplary anti-target (DLL3) (SEQ ID NO: 405) | EVQLVESGGGLVQPGGSLTLSCVASGSTSSINAMAWYRRAPG KQRELVAGISSDGSKVYADSVKGRFTISRDNAKNSVYLQMNSL RAEDTAVYYCYYYRTVSGSSMRYWGQGTLVTVSS |
| Exemplary anti-target (DLL3) (SEQ ID NO: 406) | EVQLVESGGGLVQPGGSLTLSCVASGSGSSINAMGWYRRAPG KQRELVAGISSDGSKVYSDSVKGRFTISRDNAKNSVYLQMNSLR AEDTAVYYCYYFRHVSGSSMRYWGQGTLVTVSS |
| Exemplary anti-target (DLL3) (SEQ ID NO: 407) | EVQLVESGGGLVQPGGSLTLSCVASGTTSSINAMGWYRRAPG KQRELVAGISSDGSKVYVDSVKGRFTISRDNAKNSVYLQMNSL RAEDTAVYYCYYFRFVSGSSMRYWGQGTLVTVSS |

| SEQUENCE TABLE | |
|---|---|
| DESCRIPTION | SEQUENCE |
| Exemplary anti-target (DLL3) (SEQ ID NO: 408) | EVQLVESGGGLVQPGGSLTLSCVASGSTSSINAMAWYRRAPG KQRELVAGISSDGSKVYVDSVKGRFTISRDNAKNSVYLQMNSL RAEDTAVYYCYYFRTVSGSSMRYWGQGTLVTVSS |
| Exemplary anti-target (DLL3) (SEQ ID NO: 409) | EVQLVESGGGLVQPGGSLTLSCVASGSTSRINAMGWYRRAPG KQRELVAGISSDGSKVYADSVKGRFTISRDNAKNSVYLQMNSL RAEDTAVYYCYYFRTKSGSSMRYWGQGTLVTVSS |
| Exemplary anti-target (DLL3) (SEQ ID NO: 410) | EVQLVESGGGLVQPGGSLTLSCVASGSTSRINAMGWYRRAPG KQRELVAGISSDGSKVYADSVKGRFTISRDNAKNSVYLQMNSL RAEDTAVYYCYYFRTVYGSSMRYWGQGTLVTVSS |
| Exemplary anti-target (DLL3) (SEQ ID NO: 411) | EVQLVESGGGLVQPGGSLTLSCVASGSTSSINAMGWYRRAPG KQRELVAGISSDGSKVYRDSVKGRFTISRDNAKNSVYLQMNSL RAEDTAVYYCYYFRTVSGSSMGYWGQGTLVTVSS |
| Exemplary anti-target (DLL3) (SEQ ID NO: 412) | EVQLVESGGGLVQPGGSLTLSCVASGSTSSINAMAWYRRAPG KQRELVAGISSDGSKVYSDSVKGRFTISRDNAKNSVYLQMNSLR AEDTAVYYCYYFRTVSGSSMRSWGQGTLVTVSS |
| Exemplary anti-target (DLL3) (SEQ ID NO: 413) | EVQLVESGGGLVQPGGSLTLSCVASGSTSSINAMAWYRRAPG KQRELVAGISSDNSKVYADSVKGRFTISRDNAKNSVYLQMNSL RAEDTAVYYCYYFRTVGGSSMRYWGQGTLVTVSS |
| Exemplary anti-target (DLL3) (SEQ ID NO: 414) | EVQLVESGGGLVQPGGSLTLSCVASGNTSSINAMAWYRRAPG KQRELVAGISSDGSKVYADSVKGRFTISRDNAKNSVYLQMNSL RAEDTAVYYCYYFRTVSGSSMRYWGQGTLVTVSS |
| Exemplary anti-target (DLL3) (SEQ ID NO: 415) | EVQLVESGGGLVQPGGSLTLSCVASGSTSSINAMAWYRRAPG KQRELVAGISSDGSKVYADSVKGRFTISRDNAKNSVYLQMNSL RAEDTAVYYCYYFRTVSGSHMRYWGQGTLVTVSS |
| Exemplary anti-target (DLL3) (SEQ ID NO: 416) | EVQLVESGGGLVQPGGSLTLSCVASGSTSIINAMGWYRRAPGK QRELVAGISSDGSKVYEDSVKGRFTISRDNAKNSVYLQMNSLR AEDTAVYYCYYFRAVSGSSMRYWGQGTLVTVSS |
| Exemplary anti-target (DLL3) (SEQ ID NO: 417) | EVQLVESGGGLVQPGGSLTLSCVASGSTSSINAMAWYRRAPG KQRELVAGISSDGSKVYADSVKGRFTISRDNAKNSVYLQMNSL RAEDTAVYYCYYFRTVSGSSMRYWGQGTLVTVSS |
| Exemplary anti-target (DLL3) (SEQ ID NO: 418) | EVQLVESGGGLVQPGGSLTLSCVASGSTSRINAMGWYRRAPG KQRELPAGISSDGSKVYAVSVKGRFTISRDNAKNSVYLQMNSLR AEDTAVYYCYYFRTVSGSPMRYWGQGTLVTVSS |
| Exemplary anti-target (DLL3) (SEQ ID NO: 419) | EVQLVESGGGLVQPGGSLTLSCVASGSTSRINAMGWYRRAPG KQRELVAGVSSDGSKVYADSVKGRFTISRDNAKNSVYLQMNSL RAEDTAVYYCYYFRTVSGSSMSYWGQGTLVTVSS |
| Exemplary anti-target (DLL3) (SEQ ID NO: 420) | EVQLVESGGGLVQPGGSLTLSCVASGTTSSINAMGWYRRAPG KQRELVAGISSDGSKVYEDSVKGRFTISRDNAKNSVYLQMNSLR AEDTAVYYCYYFRTVSGSSMRYWGQGTLVTVSS |
| Exemplary anti-target (DLL3) (SEQ ID NO: 421) | EVQLVESGGGLVQPGGSLTLSCVASGITSSINAMGWYRRAPGK QRELVAGISSDGSKVYAGSVKGRFTISRDNAKNSVYLQMNSLR AEDTAVYYCYYFRTVRGSSMRYWGQGTLVTVSS |
| Exemplary anti-target (DLL3) (SEQ ID NO: 422) | EVQLVESGGGLVQPGGSLTLSCVASGSTSDINAMGWYRRAPG KQRELVAGISSDKSKVYADSVKGRFTISRDNAKNSVYLQMNSLR AEDTAVYYCYYFRTVRGSSMRYWGQGTLVTVSS |
| Exemplary anti-target (DLL3) (SEQ ID NO: 423) | EVQLVESGGGLVQPGGSLTLSCVASGSTSSINAMAWYRRAPG KQRELVAGISSNGSKVYADSVKGRFTISRDNAKNSVYLQMNSL RAEDTAVYYCYYFRQVSGSSMRYWGQGTLVTVSS |
| Exemplary anti-target (DLL3) (SEQ ID NO: 424) | EVQLVESGGGLVQPGGSLTLSCVASGSTSSINAIGWYRRAPGK QRELVAGISSDGSKVLADSVKGRFTISRDNAKNSVYLQMNSLR AEDTAVYYCYYFRIVSGSSMGYWGQGTLVTVSS |
| Exemplary anti-target (DLL3) (SEQ ID NO: 425) | EVQLVESGGGLVQPGGSLTLSCVASGSTSSKNAMGWYRRAPG KQRELVAGISSDGSKVYADSVKGRFTISRDNAKNSVYLQMNSL RAEDTAVYYCYYFRTVSGASMRYWGQGTLVTVSS |

SEQUENCE TABLE

| DESCRIPTION | SEQUENCE |
| --- | --- |
| Exemplary anti-target (DLL3) (SEQ ID NO: 426) | EVQLVESGGGLVQPGGSLTLSCVASGSTSSINAMGWYRRAPG KQRELVAGISSDNSKVYADSVKGRFTISRDNAKNSVYLQMNSL RAEDTAVYYCYYFRTVHGSSMRYWGQGTLVTVSS |
| Exemplary anti-target (DLL3) (SEQ ID NO: 427) | EVQLVESGGGLVQPGGSLTLSCVASGLTSSINAMGWYRRAPG KQRELVAGISSDGSKVYADSVKGRFTISRDNAKNSVYLQMNSL RAEDTAVYYCYYFRMVSGSSMRYWGQGTLVTVSS |
| Exemplary anti-target (DLL3) (SEQ ID NO: 428) | EVQLVESGGGLVQPGGSLTLSCVASGSTSSINAMAWYRRAPG KQRELVAGISSDGSKVYTDSVKGRFTISRDNAKNSVYLQMNSLR AEDTAVYYCYYFRTISGSSMRYWGQGTLVTVSS |
| Exemplary anti-target (DLL3) (SEQ ID NO: 429) | EVQLVESGGGLVQPGGSLTLSCVASGSTSSNNAMAWYRRAPG KQRELVAGISSDGSKVYTDSVKGRFTISRDNAKNSVYLQMNSLR AEDTAVYYCYYFRTRSGSSMRYWGQGTLVTVSS |
| Exemplary anti-target (DLL3) (SEQ ID NO: 430) | EVQLVESGGGLVQPGGSLTLSCVASGSTSSINAMAWYRRAPG KQRELVAGISSDNSKVYADSVKGRFTISRDNAKNSVYLQMNSL RAEDTAVYYCYYFRTVSGHSMRYWGQGTLVTVSS |
| Exemplary anti-target (DLL3) (SEQ ID NO: 431) | EVQLVESGGGLVQPGGSLTLSCVASGSTSHINAMGWYRRAPG KQRELVAGISSDGSRVYADSVKGRFTISRDNAKNSVYLQMNSL RAEDTAVYYCYYFRTVSGGSMRYWGQGTLVTVSS |
| Exemplary anti-target (DLL3) (SEQ ID NO: 432) | EVQLVESGGGLVQPGGSLTLSCVASGQTSSINAMGWYRRAPG KQRELVAGISSDGSQVYADSVKGRFTISRDNAKNSVYLQMNSL RAEDTAVYYCYYFRTKSGSSMRYWGQGTLVTVSS |
| Exemplary anti-target (DLL3) (SEQ ID NO: 433) | EVQLVESGGGLVQPGGSLTLSCVASGSTSRINGMGWYRRAPG KQRELPAGISSDGSKAYADSVKGRFTISRDNAKNSVYLQMNSL RAEDTAVYYCYYFRTASGTSMRYWGQGTLVTVSS |
| Exemplary anti-target (DLL3) (SEQ ID NO: 434) | EVQLVESGGGLVQPGGSLTLSCVASGSTSVINAMAWYRRAPG KQRELAAGISSDGSKVYAKSAKGRFTISRDNAKNSVYLQMNSLR AEDTAVYYCYYFNTVSGSSMRYWGQGTLVTVSS |
| Exemplary anti-target (DLL3) (SEQ ID NO: 435) | EVQLVESGGGLVQPGGSLTLSCVASGSTSSINAMAWYRRAPG KQRELVAGISSDGSKVYNDSVKGRFTISRDNAKNSVYLQMNSL RAEDTAVYYCYYFRTVRGSSQRYWGQGTLVTVSS |
| Exemplary anti-target (DLL3) (SEQ ID NO: 436) | EVQLVESGGGLVQPGGSLTLSCVASGKTSSINAMGWYRRAPG KQRELVAGISSDGSKVIADSVKGRFTISRDNAKNSVYLQMNSLR AEDTAVYYCYYFRTVLGSSMRYWGQGTLVTVSS |
| Exemplary anti-target (DLL3) (SEQ ID NO: 437) | EVQLVESGGGLVQPGGSLTLSCVASGSTSSINAMAWYRRAPG KQRELVAGISSDGSKVYTDSVKGRFTISRDNAKNSVYLQMNSLR AEDTAVYYCYYFRTRSGSSMRYWGQGTLVTVSS |
| Exemplary anti-target (DLL3) (SEQ ID NO: 438) | EVQLVESGGGLVQPGGSLTLSCVASGSVSSINAMGWYRRAPG KQRELVAGISSDGSKVYIDSVKGRFTISRDNAKNSVYLQMNSL RAEDTAVYYCYYFRTVSGLSMRYWGQGTLVTVSS |
| Exemplary anti-target (DLL3) (SEQ ID NO: 439) | EVQLVESGGGLVQPGGSLTLSCVASGNTSSINAMGWYRRAPG KQRELVAGISSDGSKVYYDSVKGRFTISRDNAKNSVYLQMNSL RAEDTAVYYCYYFRTVRGSSQRYWGQGTLVTVSS |
| Exemplary anti-target (DLL3) (SEQ ID NO: 440) | EVQLVESGGGLVQPGGSLTLSCVASGSTSSTNAMGWYRRAPG KQRELVAGISSDGSKVYVDSVKGRFTISRDNAKNSVYLQMNSL RAEDTAVYYCYYFRTVSGSSMVYWGQGTLVTVSS |
| Exemplary anti-target (DLL3) (SEQ ID NO: 441) | EVQLVESGGGLVQPGGSLTLSCVASGSTSSINAMGWYRRAPG KQRELVAGISSDGSKVYGDSVKGRFTISRDNAKNSVYLQMNSL RAEDTAVYYCYYFRTVSRSSMRYWGQGTLVTVSS |
| Exemplary anti-target (DLL3) (SEQ ID NO: 442) | EVQLVESGGGLVQPGGSLTLSCVASGSTSSINAMAWYRRAPG KQRELAAGISSDQSKVYADSAKGRFTISRDNAKNSVYLQMNSL RAEDTAVYYCYYFRTVSGSSMSYWGQGTLVTVSS |
| Exemplary anti-target (DLL3) (SEQ ID NO: 443) | EVQLVESGGGLVQPGGSLTLSCVASGGTSSINAMGWYRRAPG KQRELVAGISSDGSKVYSDSVKGRFTISRDNAKNSVYLQMNSLR AEDTAVYYCYYFRTVSGSSARYWGQGTLVTVSS |

SEQUENCE TABLE

| DESCRIPTION | SEQUENCE |
|---|---|
| Exemplary anti-target (DLL3) (SEQ ID NO: 444) | EVQLVESGGGLVQPGGSLTLSCVASGSTRSINAMGWYRRAPGKQRELVAGISSDGSKVYADSVKGRFTISRDNAKNSVYLQMNSLRAEDTAVYYCYYFHTVSGSSMRYWGQGTLVTVSS |
| Exemplary anti-target (DLL3) (SEQ ID NO: 445) | EVQLVESGGGLVQPGGSLTLSCVASGTTSSINAMGWYRRAPGKQRELVAGISSDGSKVIADSVKGRFTISRDNAKNSVYLQMNSLRAEDTAVYYCYYFRTVLGSSMRYWGQGTLVTVSS |
| Exemplary anti-target (DLL3) (SEQ ID NO: 446) | EVQLVESGGGLVQPGGSLTLSCVASGSTSSINAMGWYRRAPGKQRELVAGISSDGSKVDADSVKGRFTISRDNAKNSVYLQMNSLRAEDTAVYYCYYFRTVSGSSMRYWGQGTLVTVSS |
| Exemplary anti-target (DLL3) (SEQ ID NO: 447) | EVQLVESGGGLVQPGGSLTLSCVASGSTSSINAMAWYRRAPGKQRELVAGISSDGSKVYKDSVKGRFTISRDNAKNSVYLQMNSLRAEDTAVYYCYYFRNVSGSSMRYWGQGTLVTVSS |
| Exemplary anti-target (DLL3) (SEQ ID NO: 448) | EVQLVESGGGLVQPGGSLTLSCVASGNTSSINAMGWYRRAPGKQRELVAGISSNGSKVYADSVKGRFTISRDNAKNSVYLQMNSLRAEDTAVYYCYYFRTVTGSSMRYWGQGTLVTVSS |
| Exemplary anti-target (DLL3) (SEQ ID NO: 449) | EVQLVESGGGLVQPGGSLTLSCVASGSTSRINAMGWYRRAPGKQRELVAGISSDGSKVYKDSVKGRFTISRDNAKNSVYLQMNSLRAEDTAVYYCYYFRTVSGSSMRYWGQGTLVTVSS |
| Exemplary anti-target (DLL3) (SEQ ID NO: 450) | EVQLVESGGGLVQPGGSLTLSCVASGSTSSINAIGWYRRAPGKQRELVAGISSDGSKVYADSVKGRFTISRDNAKNSVYLQMNSLRAEDTAVYYCYYFRTVKGSSMRYWGQGTLVTVSS |
| Exemplary anti-target (DLL3) (SEQ ID NO: 451) | EVQLVESGGGLVQPGGSLTLSCVASGLTSSINAMGWYRRAPGKQRELVAGISSDGSKVYQDSVKGRFTISRDNAKNSVYLQMNSLRAEDTAVYYCYYFRTNSGSSMRYWGQGTLVTVSS |
| Exemplary anti-target (DLL3) (SEQ ID NO: 452) | EVQLVESGGGLVQPGGSLTLSCVASGSTSSINAMAWYRRAPGKQRELVAGISSDGSKVYAESVKGRFTISRDNAKNSVYLQMNSLRAEDTAVYYCYYFRTVSGASMRYWGQGTLVTVSS |
| Exemplary anti-target (DLL3) (SEQ ID NO: 453) | EVQLVESGGGLVQPGGSLTLSCVASGSTSSTNAMGWYRRAPGKQRELVAGISSDGSKVLADSVKGRFTISRDNAKNSVYLQMNSLRAEDTAVYYCYYFRTVNLSSMRYWGQGTLVTVSS |
| Exemplary anti-target (DLL3) (SEQ ID NO: 454) | EVQLVESGGGLVQPGGSLTLSCVASGSTSSINAIGWYRRAPGKQRELVAGISSDGSKYYADSVKGRFTISRDNAKNSVYLQMNSLRAEDTAVYYCYYFRTVTGSSMRYWGQGTLVTVSS |
| Exemplary anti-target (DLL3) (SEQ ID NO: 455) | EVQLVESGGGLVQPGGSLTLSCVASGSTSSINAIGWYRRAPGKQRELVAGISSDGSKVYAVSVKGRFTISRDNAKNSVYLQMNSLRAEDTAVYYCYYFRKVSGSSARYWGQGTLVTVSS |
| Exemplary anti-target (DLL3) (SEQ ID NO: 456) | EVQLVESGGGLVQPGGSLTLSCVASGSTSSINAMGWYRRAPGKQRELVAGISSDGSKVVADSVKGRFTISRDNAKNSVYLQMNSLRAEDTAVYYCYYFRTYSGSSMRYWGQGTLVTVSS |
| Exemplary anti-target (DLL3) (SEQ ID NO: 457) | EVQLVESGGGLVQPGGSLTLSCVASGSTSSINAMGWYRRAPGKQRELVAGISSDGSKVYADSVKGRFTISRDNAKNSVYLQMNSLRAEDTAVYYCYYFRTVSKSSMRYWGQGTLVTVSS |
| Exemplary anti-target (DLL3) (SEQ ID NO: 458) | EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFKTVSGSSMRYWGQGTLVTVSS |
| Exemplary anti-target (DLL3) (SEQ ID NO: 459) | EVQLVESGGGLVQPGGSLTLSCVASGSTSSINAMAWYRRAPGKQRELAAGISSDNSKVYADSVKGRFTISRDNAKNSVYLQMNSLRAEDTAVYYCYYFRTRSGSSMRYWGQGTLVTVSS |
| Exemplary anti-target (DLL3) (SEQ ID NO: 460) | EVQLVESGGGLVQPGGSLTLSCVASGSKSSINAMGWYRRAPGKQRELAAGISSDGSKVYAQSVKGRFTISRDNAKNSVYLQMNSLRAEDTAVYYCYYFRTSSGSSMRYWGQGTLVTVSS |
| Exemplary anti-target (DLL3) (SEQ ID NO: 461) | EVQLVESGGGLVQPGGSLTLSCVASGTTSSINAMGWYRRAPGKQRELVAGISSDGSKVYVDSVKGRFTISRDNAKNSVYLQMNSLRAEDTAVYYCYYFRFLSGSSMRYWGQGTLVTVSS |

| SEQUENCE TABLE | |
|---|---|
| DESCRIPTION | SEQUENCE |
| Exemplary anti-target (DLL3) (SEQ ID NO: 462) | EVQLVESGGGLVQPGGSLTLSCVASGSTSSINAFGWYRRAPGK QRELVAGISSDGSKVYSDSVKGRFTISRDNAKNSVYLQMNSLRA EDTAVYYCYYFRTVSGSSMRYWGQGTLVTVSS |
| Exemplary anti-target (DLL3) (SEQ ID NO: 463) | EVQLVESGGGLVQPGGSLTLSCVASGSTFSINAMGWYRRAPG KQRELVAGISSDGSKVLADSVKGRFTISRDNAKNSVYLQMNSLR AEDTAVYYCYYFRLVSGSSMRYWGQGTLVTVSS |
| Exemplary anti-target (DLL3) (SEQ ID NO: 464) | EVQLVESGGGLVQPGGSLTLSCVASGSTRSINAMGWYRRAPG KQRELVAGISSDGSKVYNDSVKGRFTISRDNAKNSVYLQMNSL RAEDTAVYYCYYFRTVSGSSMRFWGQGTLVTVSS |
| Exemplary anti-target (DLL3) (SEQ ID NO: 465) | EVQLVESGGGLVQPGGSLTLSCVASGSTSSINAIGWYRRAPGK QRELVAGISSDGSKVYNDSVKGRFTISRDNAKNSVYLQMNSLR AEDTAVYYCYYFRTQSGSSMRYWGQGTLVTVSS |
| Exemplary anti-target (DLL3) (SEQ ID NO: 466) | EVQLVESGGGLVQPGGSLTLSCVASGSTSSINAMGWYRRAPG KQRELVAGISSDGSKVYVDSVKGRFTISRDNAKNSVYLQMNSL RAEDTAVYYCYYFRTVSGSSMPYWGQGTLVTVSS |
| Exemplary anti-target (DLL3) (SEQ ID NO: 467) | EVQLVESGGGLVQPGGSLTLSCVASGSTSSINAMGWYRRAPG KQRELVAGISSDGSKVVADSVKGRFTISRDNAKNSVYLQMNSL RAEDTAVYYCYYFRTLSGSSMRYWGQGTLVTVSS |
| Exemplary anti-target (DLL3) (SEQ ID NO: 468) | EVQLVESGGGLVQPGGSLTLSCVASGTTSSINAMGWYRRAPG KQRELVAGISSDGSKVYGDSVKGRFTISRDNAKNSVYLQMNSL RAEDTAVYYCYYFRTVSGSAMRYWGQGTLVTVSS |
| Exemplary anti-target (DLL3) (SEQ ID NO: 469) | EVQLVESGGGLVQPGGSLTLSCVASGSTSSINAMAWYRRAPG KQRELVAGISSDGSKVYTDSVKGRFTISRDNAKNSVYLQMNSLR AEDTAVYYCYYFRTTSGSSMRYWGQGTLVTVSS |
| Exemplary anti-target (DLL3) (SEQ ID NO: 470) | EVQLVESGGGLVQPGGSLTLSCVASGRTSSINAMGWYRRAPG KQRELVAGISSDGSKVYNDSVKGRFTISRDNAKNSVYLQMNSL RAEDTAVYYCYYFRTVSGTSMRYWGQGTLVTVSS |
| Exemplary anti-target (DLL3) (SEQ ID NO: 471) | EVQLVESGGGLVQPGGSLTLSCVASGSTSSRNAMGWYRRAPG KQRELVAGISSDGSKVTADSVKGRFTISRDNAKNSVYLQMNSL RAEDTAVYYCYYFRTRSGSSMRYWGQGTLVTVSS |
| Exemplary anti-target (DLL3) (SEQ ID NO: 472) | EVQLVESGGGLVQPGGSLTLSCVASGSTKSINAMGWYRRAPG KQRELVAGISSDGSKVYRDSVKGRFTISRDNAKNSVYLQMNSL RAEDTAVYYCYYFRTSSGSSMRYWGQGTLVTVSS |
| Exemplary anti-target (DLL3) (SEQ ID NO: 473) | EVQLVESGGGLVQPGGSLTLSCVASGSTSSRNAMGWYRRAPG KQRELVAGISSNGSKVYSDSVKGRFTISRDNAKNSVYLQMNSLR AEDTAVYYCYYFRTVSGSSMSYWGQGTLVTVSS |
| Exemplary anti-target (DLL3) (SEQ ID NO: 474) | EVQLVESGGGLVQPGGSLTLSCVASGSTSSINAIGWYRRAPGK QRELVAGISSDGSKVYSDSVKGRFTISRDNAKNSVYLQMNSLRA EDTAVYYCYYFRPVSGSSMRYWGQGTLVTVSS |
| Exemplary anti-target (DLL3) (SEQ ID NO: 475) | EVQLVESGGGLVQPGGSLTLSCVASGSTSLINAMGWYRRAPG KQRELVAGISSDGSKVYADSVKGRFTISRDNAKNSVYLQMNSL RAEDTAVYYCYYFRHVSGSSMRYWGQGTLVTVSS |
| Exemplary anti-target (DLL3) (SEQ ID NO: 476) | EVQLVESGGGLVQPGGSLTLSCVASGSTSSINAMAWYRRAPG KQRELVAGISSDGSKVYADSVKGRFTISRDNAKNSVYLQMNSL RAEDTAVYYCYYFRTKSGSSMRYWGQGTLVTVSS |
| Exemplary anti-target (DLL3) (SEQ ID NO: 477) | EVQLVESGGGLVQPGGSLTLSCVASGSTSSINAMGWYRRAPG KQRELVAGISSDGSLVYADSVKGRFTISRDNAKNSVYLQMNSLR AEDTAVYYCYYFTTVSGSSMRYWGQGTLVTVSS |
| Exemplary anti-target (DLL3) (SEQ ID NO: 478) | EVQLVESGGGLVQPGGSLTLSCVASGTTSSINAMGWYRRAPG KQRELVAGISSDGTKVYADSVKGRFTISRDNAKNSVYLQMNSL RAEDTAVYYCYYFHTVSGSSMRYWGQGTLVTVSS |
| Exemplary anti-target (DLL3) (SEQ ID NO: 479) | EVQLVESGGGLVQPGGSLTLSCVASGSTSSINAFGWYRRAPGK QRELVAGISSDGSKVYADSVKGRFTISRDNAKNSVYLQMNSLR AEDTAVYYCYYFRTVRGSSMRYWGQGTLVTVSS |

SEQUENCE TABLE

| DESCRIPTION | SEQUENCE |
|---|---|
| Exemplary anti-target (DLL3) (SEQ ID NO: 480) | EVQLVESGGGLVQPGGSLTLSCVASGSTSSRNAMGWYRRAPG KQRELVAGISSDGSKLYLDSVKGRFTISRDNAKNSVYLQMNSLR AEDTAVYYCYYFRTVLGSSMRYWGQGTLVTVSS |
| Exemplary anti-target (DLL3) (SEQ ID NO: 481) | EVQLVESGGGLVQPGGSLTLSCVASGNTSSINAMGWYRRAPG KQRELVAGISSDGSRVYADSVKGRFTISRDNAKNSVYLQMNSL RAEDTAVYYCYYFRTVSGSSMRSWGQGTLVTVSS |
| Exemplary anti-target (DLL3) (SEQ ID NO: 482) | EVQLVESGGGLVQPGGSLTLSCVASGTTSSINAMGWYRRAPG KQRELVAGISSDGSKVYNDSVKGRFTISRDNAKNSVYLQMNSL RAEDTAVYYCYYFRTVRGSSMRYWGQGTLVTVSS |
| Exemplary anti-target (DLL3) (SEQ ID NO: 483) | EVQLVESGGGLVQPGGSLTLSCVASGSTASINAMGWYRRAPG KQRELVAGISSDGSKVYADSVKGRFTISRDNAKNSVYLQMNSL RAEDTAVYYCYYFRYVSGSSMRYWGQGTLVTVSS |
| Exemplary anti-target (DLL3) (SEQ ID NO: 484) | EVQLVESGGGLVQPGGSLTLSCVASGSTSSINAVGWYRRAPGK QRELVAGISSDGSKVYVDSVKGRFTISRDNAKNSVYLQMNSLR AEDTAVYYCYYFRTVYGSSMRYWGQGTLVTVSS |
| Exemplary anti-target (DLL3) (SEQ ID NO: 485) | EVQLVESGGGLVQPGGSLTLSCVASGSTSSRNAMGWYRRAPG KQRELVAGISSDGSKLYADSVKGRFTISRDNAKNSVYLQMNSLR AEDTAVYYCYYFRTVLGSSMRYWGQGTLVTVSS |
| Exemplary anti-target (DLL3) (SEQ ID NO: 486) | EVQLVESGGGLVQPGGSLTLSCVASGSTNSINAMGWYRRAPG KQRELVAGISSDGSKVYKDSVKGRFTISRDNAKNSVYLQMNSLR AEDTAVYYCYYYRTVSGSSMRYWGQGTLVTVSS |
| Exemplary anti-target (DLL3) (SEQ ID NO: 487) | EVQLVESGGGLVQPGGSLTLSCVASGSTSSINAMAWYRRAPG KQRELVAGISSDGSKVYADSVKGRFTISRDNAKNSVYLQMNSL RAEDTAVYYCYYFRSVSGSSMRYWGQGTLVTVSS |
| Exemplary anti-target (DLL3) (SEQ ID NO: 488) | EVQLVESGGGLVQPGGSLTLSCVASGSTSRINAMGWYRRAPG KQRELVAGISSDGSKVYQDSVKGRFTISRDNAKNSVYLQMNSL RAEDTAVYYCYYFRRVSGSSMRYWGQGTLVTVSS |
| Exemplary anti-target (DLL3) (SEQ ID NO: 489) | EVQLVESGGGLVQPGGSLTLSCVPSGSTSNINAMGWYRRAPG KQRELPAGISSDGTKIYADSAKVPFTITRDNAKNSVYLQMNSLR AEDTAVYYCYYFRTVSGTSMRYWGQGTLVTVSS |
| Exemplary anti-target (DLL3) (SEQ ID NO: 490) | EVQLVESGGGLVQPGGSLTLSCVASGSTSKINAMGWYRRAPG KQRELVAGISSDRSKVYADSVKGRFTISRDNAKNSVYLQMNSLR AEDTAVYYCYYFRTVAGSSMRYWGQGTLVTVSS |
| Exemplary anti-target (DLL3) (SEQ ID NO: 491) | EVQLVESGGGLVQPGGSLTLSCVASGSTSSINALGWYRRAPGK QRELVAGISSDGSLVYADSVKGRFTISRDNAKNSVYLQMNSLR AEDTAVYYCYYFRIVSGSSMRYWGQGTLVTVSS |
| Exemplary anti-target (DLL3) (SEQ ID NO: 911) | EVQLVESGGGLVQPGGSLTLSCVASGKTSSINAMGWYRRAPG KQRELVAGISSDGSKVYADSVKGRFTISRDNAKNSVYLQMNSL RAEDTAVYYCYYFRTVSGVSMRYWGQGTLVTVSS |
| Exemplary anti-target (DLL3) (SEQ ID NO: 912) | EVQLVESGGGLVQPGGSLTLSCVASGSTSSINAVGWYRRAPGK QRELVAGISSDGSKVYRDSVKGRFTISRDNAKNSVYLQMNSLR AEDTAVYYCYYFRTVQGSSMRYWGQGTLVTVSS |
| Exemplary anti-target (DLL3) (SEQ ID NO: 492) | EVQLVESGGGLVQPGGSLTLSCVASGSTSRINAMGWYRRAPG KQRELVAGISSDGSKVYADSVKGRFTISRDNAKNSVYLQMNSL RAEDTAVYYCYYFRTASGSSMRYWGQGTLVTVSS |
| Exemplary anti-target (DLL3) (SEQ ID NO: 493) | EVQLVESGGGLVQPGGSLTLSCVASGSTSSINAMGWYRRAPG KQRELVAGISSDGSKVYSDSVKGRFTISRDNAKNSVYLQMNSLR AEDTAVYYCYYFRTVSGSSSRYWGQGTLVTVSS |
| Exemplary anti-target (DLL3) (SEQ ID NO: 494) | EVQLVESGGGLVQPGGSLTLSCVASGSTSSINAVGWYRRAPGK QRELVAGISSDGTKVYRDSVKGRFTISRDNAKNSVYLQMNSLR AEDTAVYYCYYFRTVQGSSMRYWGQGTLVTVSS |
| Exemplary anti-target (DLL3) (SEQ ID NO: 495) | EVQLVESGGGLVQPGGSLTLSCVASGTTSSINAMGWYRRAPG KQRELAAGISSDGSKVYNDSVKGRFTISRDNAKNSVYLQMNSL RAEDTAVYYCYYFRTVRGSSMRYWGQGTLVTVSS |

| SEQUENCE TABLE | |
|---|---|
| DESCRIPTION | SEQUENCE |
| Exemplary anti-target (DLL3) (SEQ ID NO: 496) | EVQLVESGGGLVQPGGSLTLSCVASGSTSSINAMGWYRRAPG KQRELVAGISSDGSKVYADSVKGRFTISRDNAKNSVYLQMNSL RAEDTAVYYCYYFRTKSGSSMRYWGQGTLVTVSS |
| Exemplary anti-target (DLL3) (SEQ ID NO: 497) | EVQLVESGGGLVQPGGSLTLSCVASGTTSSINAMGWYRRAPG KQRELVAGISSDGSKVYADSVKGRFTISRDNAKNSVYLQMNSL RAEDTAVYYCYYFRTVWGSSMRYWGQGTLVTVSS |
| Exemplary anti-target (DLL3) (SEQ ID NO: 498) | EVQLVESGGGLVQPGGSLTLSCVASGKTSSINAMGWYRRAPG KQRELVAGISSDGSKVYTDSVKGRFTISRDNAKNSVYLQMNSLR AEDTAVYYCYYFRTRSGSSMRYWGQGTLVTVSS |
| Exemplary anti-target (DLL3) (SEQ ID NO: 499) | EVQLVESGGGLVQPGGSLTLSCVASGSTSSINAMGWYRRAPFK QGELPAGISPDGTKAYADSAKVRFTISRDNAKNSVYLQMNSLR AEDTAVYYCYYFHTVCGTSMGYWGQGTLVTVSS |
| Exemplary anti-target (DLL3) (SEQ ID NO: 500) | EVQLVESGGGLVQPGGSLTLSCVASGSTSAINAMGWYRRAPG KQRELVAGISSDGSKVYVDSVKGRFTISRDNAKNSVYLQMNSL RAEDTAVYYCYYFRTVSGSSQRYWGQGTLVTVSS |
| Exemplary anti-target (DLL3) (SEQ ID NO: 501) | EVQLVESGGGLVQPGGSLTLSCVASGSPSSINAYGWYRRAPGK QRELVAGISSDGSKVYSDSVKGRFTISRDNAKNSVYLQMNSLRA EDTAVYYCYYFRTVSGSSMSYWGQGTLVTVSS |
| Exemplary anti-target (DLL3) (SEQ ID NO: 502) | EVQLVESGGGLVQPGGSLTLSCVASGSTSSINAMGWYRRAPG KQRELVAGISSDGSKVYASSVKGRFTISRDNAKNSVYLQMNSLR AEDTAVYYCYYFRTVRGSSMRYWGQGTLVTVSS |
| Exemplary anti-target (DLL3) (SEQ ID NO: 503) | EVQLVESGGGLVQPGGSLTLSCVASGSRSSINAMGWYRRAPG KQRELVAGISADGSKVYADSVKGRFTISRDNAKNSVYLQMNSL RAEDTAVYYCYYFRTQSGSSMRYWGQGTLVTVSS |
| Exemplary anti-target (DLL3) (SEQ ID NO: 504) | EVQLVESGGGLVQPGGSLTLSCVASGSVSSINAMGWYRRAPG KQRELVAGISSDGSKVYASSAKGRFTISRDNAKNSVYLQMNSL RAEDTAVYYCYYFRTLSGSSMRYWGQGTLVTVSS |
| Exemplary anti-target (DLL3) (SEQ ID NO: 505) | EVQLVESGGGLVQPGGSLTLSCVASGSTSSINAMAWYRRAPG KQRELVAGISSDGSKVYADSVKGRFTISRDNAKNSVYLQMNSL RAEDTAVYYCYYFHTVSGSSMRYWGQGTLVTVSS |
| Exemplary anti-target (DLL3) (SEQ ID NO: 506) | EVQLVESGGGLVQPGGSLTLSCVASGSTSSINAIGWYRRAPGK QRELVAGISSDGSSVYADSVKGRFTISRDNAKNSVYLQMNSLR AEDTAVYYCYYFRRVSGSSMRYWGQGTLVTVSS |
| Exemplary anti-target (DLL3) (SEQ ID NO: 507) | EVQLVESGGGLVQPGGSLTLSCVASGSTSSINAMGWYRRAPG KQRELVAGISSDGSKVYSDSVKGRFTISRDNAKNSVYLQMNSLR AEDTAVYYCYYFRLVSGSSMRYWGQGTLVTVSS |
| Exemplary anti-target (DLL3) (SEQ ID NO: 508) | EVQLVESGGGLVQPGGSLTLSCVASGSTSSINAVGWYRRAPGK QRELVAGISSDGSKVYAGSVKGRFTISRDNAKNSVYLQMNSLR AEDTAVYYCYYFRTVSGSYMRYWGQGTLVTVSS |
| Exemplary anti-target (DLL3) (SEQ ID NO: 509) | EVQLVESGGGLVQPGGSLTLSCVASGSTSSINAMAWYRRAPG KQRELAAGISSDNSKVYADSVKGRFTISRDNAKNSVYLQMNSL RAEDTAVYYCYYFRTVGGSSMRYWGQGTLVTVSS |
| Exemplary anti-target (DLL3) (SEQ ID NO: 510) | EVQLVESGGGLVQPGGSLTLSCVASGSTSSINAYGWYRRAPGK QRELVAGISSDGSAVYADSVKGRFTISRDNAKNSVYLQMNSLR AEDTAVYYCYYFRTHSGSSMRYWGQGTLVTVSS |
| Exemplary anti-target (DLL3) (SEQ ID NO: 511) | EVQLVESGGGLVQPGGSLTLSCVASGSTSSINAVGWYRRAPGK QRELVAGISSDGSSVYADSVKGRFTISRDNAKNSVYLQMNSLR AEDTAVYYCYYFRTVSTSSMRYWGQGTLVTVSS |
| Exemplary anti-target (DLL3) (SEQ ID NO: 512) | EVQLVESGGGLVQPGGSLTLSCVASGSKSSINAMGWYRRAPG KQRELPAGISSNGTKVYADSAKVRFTISRDNAKNSVYLQMNSL RAEDTAVYYCYYFRTVLGTSMRYWGQGTLVTVSS |
| Exemplary anti-target (DLL3) (SEQ ID NO: 513) | EVQLVESGGGLVQPGGSLTLSCVASGSTSSINAMAWYRRAPG KQRELVAGISSDGSKLYADSVKGRFTISRDNAKNSVYLQMNSLR AEDTAVYYCYYFRTVSGSSMRYWGQGTLVTVSS |

SEQUENCE TABLE

| DESCRIPTION | SEQUENCE |
|---|---|
| Exemplary anti-target (DLL3) (SEQ ID NO: 514) | EVQLVESGGGLVQPGGSLTLSCVASGSVSSINAMGWYRRAPG KQRELVAGISSDGSKVYKDSVKGRFTISRDNAKNSVYLQMNSLR AEDTAVYYCYYFRTVSGSSMGYWGQGTLVTVSS |
| Exemplary anti-target (DLL3) (SEQ ID NO: 515) | EVQLVESGGGLVQPGGSLTLSCVASGSTSSINAMGWYRRAPG KQRELVAGISSDGSLVYADSVKGRFTISRDNAKNSVYLQMNSLR AEDTAVYYCYYFRTVSGSSMRAWGQGTLVTVSS |
| Exemplary anti-target (DLL3) (SEQ ID NO: 516) | EVQLVESGGGLVQPGGSLTLSCVASGSTSSINAMGWYRRAPG KQRELVAGISSDGSLVYADSVKGRFTISRDNAKNSVYLQMNSLR AEDTAVYYCYYFRILSGSSMRYWGQGTLVTVSS |
| Exemplary anti-target (DLL3) (SEQ ID NO: 517) | EVQLVESGGGLVQPGGSLTLSCVASGSTSSINAMAWYRRAPG KQRELVAGISSDGSKVYADSVKGRFTISRDNAKNSVYLQMNSL RAEDTAVYYCYYFRTVQGSSMRYWGQGTLVTVSS |
| Exemplary anti-target (DLL3) (SEQ ID NO: 518) | EVQLVESGGGLVQPGGSLTLSCVASGSTSYINAMGWYRRAPG KQRELVAGISSDGSKVYADSVKGRFTISRDNAKNSVYLQMNSL RAEDTAVYYCYYFRTVSGQSMGYWGQGTLVTVSS |
| Exemplary anti-target (DLL3) (SEQ ID NO: 913) | EVQLVESGGGLVQPGGSLTLSCVASGSTSSINAMGWYRRAPG KQRELVAGVSSDGSKVYADSVKGRFTISRDNAKNSVYLQMNSL RAEDTAVYYCYYFRTVSGSSARYWGQGTLVTVSS |
| Exemplary anti-target (DLL3) (SEQ ID NO: 914) | EVQLVESGGGLVQPGGSLTLSCVASGSTSSINAMGWYRRAPG KQRELPAGISRDGSKVYADSVKGRFTISRDNAKNSVYLQMNSL RAEDTAVYYCYYFRYVSGSSMRYWGQGTLVTVSS |
| Exemplary anti-target (DLL3) (SEQ ID NO: 915) | EVQLVESGGGLVQPGGSLTLSCVASGSTSSINAMGWYRRAPG KQRELAAGISSDGSKLYADSVKGRFTISRDNAKNSVYLQMNSLR AEDTAVYYCYYFRTVSGSSMRYWGQGTLVTVSS |
| Exemplary anti-target (DLL3) (SEQ ID NO: 916) | EVQLVESGGGLVQPGGSLTLSCVASGSTSRINAMGWYRRAPG KQRELVAGISSDGSKVYADSVKGRFTISRDNAKNSVYLQMNSL RAEDTAVYYCYYFRRVSGSSMRYWGQGTLVTVSS |
| Exemplary anti-target (DLL3) (SEQ ID NO: 917) | EVQLVESGGGLVQPGGSLTLSCVASGSTSSINAMAWYRRAPG KQRELAAGISSDGSKVYADSVKGRFTISRDNAKNSVYLQMNSL RAEDTAVYYCYYFHTVSGSSMRYWGQGTLVTVSS |
| Exemplary anti-target (DLL3) (SEQ ID NO: 918) | EVQLVESGGGLVQPGGSLTLSCVASGSTSSINAMAWYRRAPG KQRELVAGISSDGSKVYADSVKGRFTISRDNAKNSVYLQMNSL RAEDTAVYYCYYFRQVSGSSMRYWGQGTLVTVSS |
| Exemplary anti-target (DLL3) (SEQ ID NO: 919) | EVQLVESGGGLVQPGGSLTLSCVASGSTSSINAMGWYRRAPG KQRELVAGISSDTSKVYADSVKGRFTISRDNAKNSVYLQMNSLR AEDTAVYYCYYFRTVSGSYMRYWGQGTLVTVSS |
| Exemplary anti-target (DLL3) (SEQ ID NO: 920) | EVQLVESGGGLVQPGGSLTLSCVASGSTSTINAMGWYRRAPG KQRELVAGISSDGSKVYADSVKGRFTISRDNAKNSVYLQMNSL RAEDTAVYYCYYFRTASGSSMRYWGQGTLVTVSS |
| Exemplary anti-target (DLL3) (SEQ ID NO: 519) | EVQLVESGGGLVQPGGSLTLSCVASGSTSSINAVGWYRRAPGK QRELVAGISSDGSTVYADSVKGRFTISRDNAKNSVYLQMNSLR AEDTAVYYCYYFRTVSGHSMRYWGQGTLVTVSS |
| Exemplary anti-target (DLL3) (SEQ ID NO: 520) | EVQLVESGGGLVQPGGSLTLSCVASGSTSSINAMGWYRRAPG KQRELAAGISKDGSKVYADSAKGRFTISRDNAKNSVYLQMNSL RAEDTAVYYCYYFRTVSGSSSRYWGQGTLVTVSS |
| Exemplary anti-target (DLL3) (SEQ ID NO: 521) | EVQLVESGGGLVQPGGSLTLSCVASGSPSSINAYGWYRRAPGK QRELVAGISSDGSKVYSDSVKGRFTISRDNAKNSVYLQMNSLRA EDTAVYYCYYFRTVSGSSYSYWGQGTLVTVSS |
| Exemplary anti-target (DLL3) (SEQ ID NO: 522) | EVQLVESGGGLVQPGGSLTLSCVASGSPSSINAYGWYRRAPGK QRELVAGISSDGSKVYSDSVKGRFTISRDNAKNSVYLQMNSLRA EDTAVYYCYYFRTVSGSSQSYWGQGTLVTVSS |
| Exemplary anti-target (DLL3) (SEQ ID NO: 523) | EVQLVESGGGLVQPGGSLTLSCAASGSSVKFLSMAWYRQAPG KKRELVAGISADGSTDYIDSVKGRFTISRDNAKNSVYLQMNSLR AEDTAVYYCAYRWTRRYTYWGQGTLVTVSS |

-continued

| SEQUENCE TABLE | |
|---|---|
| DESCRIPTION | SEQUENCE |
| Exemplary anti-target (DLL3) (SEQ ID NO: 524) | EVQLVESGGGLVQPGGSLTLSCAASGSSVSFLSLAWYRQAPGK KRELVAGISADGSTAYIDSVKGRFTISRDNAKNSVYLQMNSLRA EDTAVYYCYAYRWRTRYTYWGQGTLVTVSS |
| Exemplary anti-target (DLL3) (SEQ ID NO: 525) | EVQLVESGGGLVQPGGSLTLSCAASGSRVSFLSMAWYRQAPG KKRELVAGISRDGSTDYIDSVKGRFTISRDNAKNSVYLQMNSLR AEDTAVYYCYAYRWTTRRTYWGQGTLVTVSS |
| Exemplary anti-target (DLL3) (SEQ ID NO: 526) | EVQLVESGGGLVQPGGSLTLSCAASGSQVSFLSMAWYRQAPG KKRELVAGISRDGSTDYIDSVKGRFTISRDNAKNSVYLQMNSLR AEDTAVYYCYAYRWTTRYIYWGQGTLVTVSS |
| Exemplary anti-target (DLL3) (SEQ ID NO: 527) | EVQLVESGGGLVQPGGSLTLSCAASGSSVSFLSMAWYRQAPG KKRELVAGISEAGSTDYIDSVKGRFTISRDNAKNSVYLQMNSLR AEDTAVYYCYAYRWRTRYTYWGQGTLVTVSS |
| Exemplary anti-target (DLL3) (SEQ ID NO: 528) | EVQLVESGGGLVQPGGSLTLRCAASGSKVSFLSMAWYRQAPG KKRELVAGISADGSTDYVDSVKGRFTISRDNAKNSVYLQMNSL RAEDTAVYYCYAYRWTRRYTYWGQGTLVTVSS |
| Exemplary anti-target (DLL3) (SEQ ID NO: 529) | EVQLVESGGGLVQPGGSLTLSCAASGSSVGFLSMAWYRQAPG KKRELVAGISADGSTDYIRSVKGRFTISRDNAKNSVYLQMNSLR AEDTAVYYCYAYRWRTRYTYWGQGTLVTVSS |
| Exemplary anti-target (DLL3) (SEQ ID NO: 530) | EVQLVESGGGLVQPGGSLTLSCAASGSSVSFLSMAWYRQAPG KKRELVAGISADGSVDYIDSVKGRFTISRDNAKNSVYLQMNSLR AEDTAVYYCYAYRWTTRYIYWGQGTLVTVSS |
| Exemplary anti-target (DLL3) (SEQ ID NO: 531) | EVQLVESGGGLVQPGGSLTLSCAASGSRVSFLSMAWYRQAPG KKRELVAGISADGSTLYIDSVKGRFTISRDNAKNSVYLQMNSLR AEDTAVYYCYAYRWTTRRTYWGQGTLVTVSS |
| Exemplary anti-target (DLL3) (SEQ ID NO: 532) | EVQLVESGGGLVQPGGSLTLSCAASGSSVSFLSLAWYRQAPGK KRELVAGISTDGSTDYIDSVKGRFTISRDNAKNSVYLQMNSLRA EDTAVYYCYAYRWRTRYTYWGQGTLVTVSS |
| Exemplary anti-target (DLL3) (SEQ ID NO: 533) | EVQLVESGGGLVQPGGSLTLSCAASGSSVSFLSMAWYRQAPG KKRELVAGISGDGSTDYIDSVKGRFTISRDNAKNSVYLQMNSLR AEDTAVYYCYAYRWTTRYTYWGQGTLVTVSS |
| Exemplary anti-target (DLL3) (SEQ ID NO: 534) | EVQLVESGGGLVQPGGSLTLSCAASGSSVQFLSMAWYRQAPG KKRELVAGISADGSTDYINSVKGRFTISRDNAKNSVYLQMNSLR AEDTAVYYCYAYRWRTRYTYWGQGTLVTVSS |
| Exemplary anti-target (DLL3) (SEQ ID NO: 535) | EVQLVESGGGLVQPGGSLTLSCAASGSNVSFLSMAWYRQAPG KKRELVAGISARGSTDYIDSVKGRFTISRDNAKNSVYLQMNSLR AEDTAVYYCYAYHWTTRYTYWGQGTLVTVSS |
| Exemplary anti-target (DLL3) (SEQ ID NO: 536) | EVQLVESGGGLVQPGGSLTLSCVASGSSVKFLSMAWYRQAPG KKRELVAGISADGSTTYIDSVKGRFTISRDNAKNSVYLQMNSLR AEDTAVYYCYAYRWTTRRTYWGQGTLVTVSS |
| Exemplary anti-target (DLL3) (SEQ ID NO: 537) | EVQLVESGGGLVQPGGSLTLSCAASGKSVSFLSMAWYRQAPG KKRELVAGISKDGSTDYIDSVKGRFTISRDNAKNSVYLQMNSLR AEDTAVYYCYAYRWTTRYTYWGQGTLVTVSS |
| Exemplary anti-target (DLL3) (SEQ ID NO: 538) | EVQLVESGGGLVQPGGSLTLSCAASGSRVSFLSMAWYRQAPG KKRELVAGISADGSTTYIDSVKGRFTISRDNAKNSVYLQMNSLR AEDTAVYYCYAYRWTTRYTYWGQGTLVTVSS |
| Exemplary anti-target (DLL3) (SEQ ID NO: 539) | EVQLVESGGGLVQPGGSLTLSCAASGSHVSFLSMAWYRQAPG KKRELVAGISANGSTDYIDSVKGRFTISRDNAKNSVYLQMNSLR AEDTAVYYCYAYRWTTRYAYWGQGTLVTVSS |
| Exemplary anti-target (DLL3) (SEQ ID NO: 540) | EVQLVESGGGLVQPGGSLTLSCAASGSSVSFLSMAWYRQAPG KKRELVAGISRDGSTDYIDSVKGRFTISRDNAKNSVYLQMNSLR AEDTAVYYCYAYRWVTRYTYWGQGTLVTVSS |
| Exemplary anti-target (DLL3) (SEQ ID NO: 541) | EVQLVESGGGLVQPGGSLTLSCAASGSSVSFLSMAWYRQAPG KKRELVAGISADGSADYIDSVKGRFTISRDNAKNSVYLQMNSLR AEDTAVYYCYAYRWVTRYTYWGQGTLVTVSS |

SEQUENCE TABLE

| DESCRIPTION | SEQUENCE |
|---|---|
| Exemplary anti-target (DLL3)<br>(SEQ ID NO: 542) | EVQLVESGGGLVQPGGSLTLSCAASGSSVRFLSMAWYRQAPG<br>KKRELVAGISAHGSTDYIDSVKGRFTISRDNAKNSVYLQMNSLR<br>AEDTAVYYCYAYRWSTRYTYWGQGTLVTVSS |
| Exemplary anti-target (DLL3)<br>(SEQ ID NO: 543) | EVQLVESGGGLVQPGGSLTLSCAASGSSVRFLSMAWYRQAPG<br>KKRELVAGISADGSTIYIDSVKGRFTISRDNAKNSVYLQMNSLRA<br>EDTAVYYCYAYRWRTRYTYWGQGTLVTVSS |
| Exemplary anti-target (DLL3)<br>(SEQ ID NO: 544) | EVQLVESGGGLVQPGGSLTLSCAASGSSVRFLSMAWYRQAPG<br>KKRELVAGISRDGSTVYIDSVKGRFTISRDNAKNSVYLQMNSLR<br>AEDTAVYYCYAYRWTTRGTYWGQGTLVTVSS |
| Exemplary anti-target (DLL3)<br>(SEQ ID NO: 545) | EVQLVESGGGLVQPGGSLTLSCAASGSHVSFLSMAWYRQAPG<br>KKRELVAGISADGPTDYIDSVKGRFTISRDNAKNSVYLQMNSLR<br>AEDTAVYYCYAYRWDTRYTYWGQGTLVTVSS |
| Exemplary anti-target (DLL3)<br>(SEQ ID NO: 546) | EVQLVESGGGLVQPGGSLTLSCVASGTSVSFLSMAWYRQAPG<br>KKRELVAGISADGSTTYIDSVKGRFTISRDNAKNSVYLQMNSLR<br>AEDTAVYYCYAYRWTTRRTYWGQGTLVTVSS |
| Exemplary anti-target (DLL3)<br>(SEQ ID NO: 547) | EVQLVESGGGLVQPGGSLTLSCAASGTSVSFLSIAWYRQAPGK<br>KRELVAGISADGSTDYIASVKGRFTISRDNAKNSVYLQMNSLRA<br>EDTAVYYCYAYRWRTRYTYWGQGTLVTVSS |
| Exemplary anti-target (DLL3)<br>(SEQ ID NO: 548) | EVQLVESGGGLVQPGGSLTLSCAASGSSVKFLSMAWYRQAPG<br>KKRELVAGISLDGSTDYIDSVKGRFTISRDNAKNSVYLQMNSLR<br>AEDTAVYYCYAYRWTGRYTYWGQGTLVTVSS |
| Exemplary anti-target (DLL3)<br>(SEQ ID NO: 549) | EVQLVESGGGLVQPGGSLTLSCAASGSSVSFLSMAWYRQAPG<br>KKRELVAGISADGSTIYIDSVKGRFTISRDNAKNSVYLQMNSLRA<br>EDTAVYYCYAYRWRTRYTYWGQGTLVTVSS |
| Exemplary anti-target (DLL3)<br>(SEQ ID NO: 550) | EVQLVESGGGLVQPGGSLTLSCAASGSSVRFLSMAWYRQAPG<br>KKRELVAGISAHGSTDYIDSVKGRFTISRDNAKNSVYLQMNSLR<br>AEDTAVYYCYAYRWRTRYTYWGQGTLVTVSS |
| Exemplary anti-target (DLL3)<br>(SEQ ID NO: 551) | EVQLVESGGGLVQPGGSLTLSCAASGSSVRFLSMAWYRQAPG<br>KKRELVAGISRDGSTDYIDSVKGRFTISRDNAKNSVYLQMNSLR<br>AEDTAVYYCYAYRWITRYTYWGQGTLVTVSS |
| Exemplary anti-target (DLL3)<br>(SEQ ID NO: 552) | EVQLVESGGGLVQPGGSLTLSCAASGSSVRFLSMAWYRQAPG<br>KKRELVAGISRDGSTDYIDSVKGRFTISRDNAKNSVYLQMNSLR<br>AEDTAVYYCYAYRWITRYTYWGQGTLVTVSS |
| Exemplary anti-target (DLL3)<br>(SEQ ID NO: 553) | EVQLVESGGGLVQPGGSLTLSCAASGSSVVFLSMAWYRQAPG<br>KKRELVAGISADGSMDYIDSVKGRFTISRDNAKNSVYLQMNSL<br>RAEDTAVYYCYAYRWRTRYTYWGQGTLVTVSS |
| Exemplary anti-target (DLL3)<br>(SEQ ID NO: 554) | EVQLVESGGGLVQPGGSLTLSCAASGSSVRFLSMAWYRQAPG<br>KKRELVAGISADGSTDYIDSVKGRFTISRDNAKNSVYLQMNSLR<br>AEDTAVYYCYAYRWTRRYTYWGQGTLVTVSS |
| Exemplary anti-target (DLL3)<br>(SEQ ID NO: 555) | EVQLVESGGGLVQPGGSLTLSCAASGSSVRFLSMAWYRQAPG<br>KKRELVAGISADGSTDYIDSVKGRFTISRDNAKNSVYLQMNSLR<br>AEDTAVYYCYAYSWTTRYTYWGQGTLVTVSS |
| Exemplary anti-target (DLL3)<br>(SEQ ID NO: 556) | EVQLVESGGGLVQPGGSLTLSCAASGSSVRFLSMAWYRQAPG<br>KKRELVAGISANGSTDYIDSVKGRFTISRDNAKNSVYLQMNSLR<br>AEDTAVYYCYAYRWTNRYTYWGQGTLVTVSS |
| Exemplary anti-target (DLL3)<br>(SEQ ID NO: 557) | EVQLVESGGGLVQPGGSLTLSCAASGSSVSRLSMAWYRQAPG<br>KKRELVAGISANGSTTYIDSVKGRFTISRDNAKNSVYLQMNSLR<br>AEDTAVYYCYAYRWTTRYRYWGQGTLVTVSS |
| Exemplary anti-target (DLL3)<br>(SEQ ID NO: 558) | EVQLVESGGGLVQPGGSLTLSCAASGSSKSFLSMAWYRQAPG<br>KKRELVAGISADGSTSYIDSVKGRFTISRDNAKNSVYLQMNSLR<br>AEDTAVYYCYAYRWTTRYTYWGQGTLVTVSS |
| Exemplary anti-target (DLL3)<br>(SEQ ID NO: 559) | EVQLVESGGGLVQPGGSLTLSCAASGSSVSRLSMAWYRQAPG<br>KKRELVAGISADGSRDYIDSVKGRFTISRDNAKNSVYLQMNSLR<br>AEDTAVYYCYAYRWTTRYKYWGQGTLVTVSS |

-continued

| SEQUENCE TABLE | |
|---|---|
| DESCRIPTION | SEQUENCE |
| Exemplary anti-target (DLL3) (SEQ ID NO: 560) | EVQLVESGGGLVQPGGSLTLSCAASGSSVKFLSMAWYRQAPG KKRELVAGISADGSTMYIDSVKGRFTISRDNAKNSVYLQMNSLR AEDTAVYYCYAYRWHTRYTYWGQGTLVTVSS |
| Exemplary anti-target (DLL3) (SEQ ID NO: 561) | EVQLVESGGGLVQPGGSLTLSCAASGSGVRFLSMAWYRQAPG KKRELVAGISPDGSTDYIDSVKGRFTISRDNAKNSVYLQMNSLR AEDTAVYYCYAYRWTRRYTYWGQGTLVTVSS |
| Exemplary anti-target (DLL3) (SEQ ID NO: 562) | EVQLVESGGGLVQPGGSLTLSCAASGSSVRFLSMAWYRQAPG KKRELVAGISGDGSTDYIDSVKGRFTISRDNAKNSVYLQMNSLR AEDTAVYYCYAYRWMTRYTYWGQGTLVTVSS |
| Exemplary anti-target (DLL3) (SEQ ID NO: 563) | EVQLVESGGGLVQPGGSLTLSCAASGSSVHFLSMAWYRQAPG KKRELVAGISRDGSTDYIDSVKGRFTISRDNAKNSVYLQMNSLR AEDTAVYYCYAYRWTTRYRYWGQGTLVTVSS |
| Exemplary anti-target (DLL3) (SEQ ID NO: 564) | EVQLVESGGGLVQPGGSLTLSCAASGSSVRFLSMAWYRQAPG KKRELVAGISRDGSTDYIDSVKGRFTISRDNAKNSVYLQMNSLR AEDTAVYYCYAYRWSTRYTYWGQGTLVTVSS |
| Exemplary anti-target (DLL3) (SEQ ID NO: 565) | EVQLVESGGGLVQPGGSLTLSCAASGSKVSFLSMAWYRQAPG KKRELVAGISRDGSTDYIDSVKGRFTISRDNAKNSVYLQMNSLR AEDTAVYYCYAYRWTTRYTFWGQGTLVTVSS |
| Exemplary anti-target (DLL3) (SEQ ID NO: 566) | EVQLVESGGGLVQPGGSLTLSCAASGSSVSFLSMAWYRQAPG KKRELVAGISADGSTDYIDSVKGRFTISRDNAKNSVYLQMNSLR AEDTAVYYCYAYRWRTRYTYWGQGTLVTVSS |
| Exemplary anti-target (DLL3) (SEQ ID NO: 567) | EVQLVESGGGLVQPGGSLTLSCAASGSKVSFLSMAWYRQAPG KKRELVAGISTDGSTDYIDSVKGRFTISRDNAKNSVYLQMNSLR AEDTAVYYCYAYRWTTRRTYWGQGTLVTVSS |
| Exemplary anti-target (DLL3) (SEQ ID NO: 568) | EVQLVESGGGLVQPGGSLTLSCAASGSRVSFLSMAWYRQAPG KKRELVAGISADGSTSYIDSVKGRFTISRDNAKNSVYLQMNSLR AEDTAVYYCYAYRWATRYTYWGQGTLVTVSS |
| Exemplary anti-target (DLL3) (SEQ ID NO: 569) | EVQLVESGGGLVQPGGSLTLSCAASGSRVSFLSMAWYRQAPG KKRELVAGISADGSTLYIDSVKGRFTISRDNAKNSVYLQMNSLR AEDTAVYYCYAYRWHTRYTYWGQGTLVTVSS |
| Exemplary anti-target (DLL3) (SEQ ID NO: 570) | EVQLVESGGGLVQPGGSLTLSCAASGSSVRFLSMAWYRQAPG KKRELVAGISRDGSTDYIDSVKGRFTISRDNAKNSVYLQMNSLR AEDTAVYYCYAYRWGTRYTYWGQGTLVTVSS |
| Exemplary anti-target (DLL3) (SEQ ID NO: 571) | EVQLVESGGGLVQPGGSLTLSCAASYSSVSRLSMAWYRQAPG KKRELVAGISADGSTVYIDSVKGRFTISRDNAKNSVYLQMNSLR AEDTAVYYCYAYRWTTRNTYWGQGTLVTVSS |
| Exemplary anti-target (DLL3) (SEQ ID NO: 572) | EVQLVESGGGLVQPGGSLTLSCAASGSSVSFLSMAWYRQAPG KKRELVAGISTDGSTDYIDSVKGRFTISRDNAKNSVYLQMNSLR AEDTAVYYCYAYRWRTRYTYWGQGTLVTVSS |
| Exemplary anti-target (DLL3) (SEQ ID NO: 573) | EVQLVESGGGLVQPGGSLTLSCAASGSSVSFLSMAWYRQAPG KKRELVAGISADGSTLYIDSVKGRFTISRDNAKNSVYLQMNSLR AEDTAVYYCYAYRWTTRYAYWGQGTLVTVSS |
| Exemplary anti-target (DLL3) (SEQ ID NO: 574) | EVQLVESGGGLVQPGGSLTLSCAASGSSVSFLSMAWYRQAPG KKRELVAGISADGRTDYIDSVKGRFTISRDNAKNSVYLQMNSLR AEDTAVYYCYAYRWRTRYTYWGQGTLVTVSS |
| Exemplary anti-target (DLL3) (SEQ ID NO: 575) | EVQLVESGGGLVQPGGSLTLSCVASGTSVSFLSMAWYRQAPG KKRELVAGISADGSTIYIDSVKGRFTISRDNAKNSVYLQMNSLRA EDTAVYYCYAYRWTTRRTYWGQGTLVTVSS |
| Exemplary anti-target (DLL3) (SEQ ID NO: 576) | EVQLVESGGGLVQPGGSLTLSCAASGSSVKFLSMAWYRQAPG KKRELVAGISADGSTLYIDSVKGRFTISRDNAKNSVYLQMNSLR AEDTAVYYCYAYRWTTRRTYWGQGTLVTVSS |
| Exemplary anti-target (DLL3) (SEQ ID NO: 577) | EVQLVESGGGLVQPGGSLTLSCAASGSSVSFLSMAWYRQAPG KKRELVAGISRDGSTDYIDSVKGRFTISRDNAKNSVYLQMNSLR AEDTAVYYCYAYRWTSRYTYWGQGTLVTVSS |

-continued

| DESCRIPTION | SEQUENCE |
|---|---|
| Exemplary anti-target (DLL3) (SEQ ID NO: 578) | EVQLVESGGGLVQPGGSLTLSCAASGSRVSFLSMAWYRQAPG KKRELVAGISKDGSTDYIDSVKGRFTISRDNAKNSVYLQMNSLR AEDTAVYYCYAYRWTTRVTYWGQGTLVTVSS |
| Exemplary anti-target (DLL3) (SEQ ID NO: 579) | EVQLVESGGGLVQPGGSLTLSCAASGSSVSVLSMAWYRQAPG KKRELVAGISADGSTDYIGSVKGRFTISRDNAKNSVYLQMNSLR AEDTAVYYCYAYRWTTRTTYWGQGTLVTVSS |
| Exemplary anti-target (DLL3) (SEQ ID NO: 580) | EVQLVESGGGLVQPGGSLTLSCAASGSSVSFLSMAWYRQAPG KKRELVAGISVDGSTDYIDSVKGRFTISRDNAKNSVYLQMNSLR AEDTAVYYCYAYRWRTRYTYWGQGTLVTVSS |
| Exemplary anti-target (DLL3) (SEQ ID NO: 581) | EVQLVESGGGLVQPGGSLTLSCAASGSRVSFLSMAWYRQAPG KKRELVAGISADGSTGYIDSVKGRFTISRDNAKNSVYLQMNSLR AEDTAVYYCYAYRWATRYTYWGQGTLVTVSS |
| Exemplary anti-target (DLL3) (SEQ ID NO: 582) | EVQLVESGGGLVQPGGSLTLSCVASGSSVKFLSMAWYRQAPG KKRELVAGISGDGSTTYIDSVKGRFTISRDNAKNSVYLQMNSLR AEDTAVYYCYAYRWTTRRTYWGQGTLVTVSS |
| Exemplary anti-target (DLL3) (SEQ ID NO: 583) | EVQLVESGGGLVQPGGSLTLSCAASGSSVRFLSMAWYRQAPG KKRELVAGISTDGSTDYIDSVKGRFTISRDNAKNSVYLQMNSLR AEDTAVYYCYALRWTTRYTYWGQGTLVTVSS |
| Exemplary anti-target (DLL3) (SEQ ID NO: 584) | EVQLVESGGGLVQPGGSLTLSCAASGSSVSQLSMAWYRQAPG KKRELVAGISADGSTDYFDSVKGRFTISRDNAKNSVYLQMNSLR AEDTAVYYCYAYRWTTRGTYWGQGTLVTVSS |
| Exemplary anti-target (DLL3) (SEQ ID NO: 585) | EVQLVESGGGLVQPGGSLTLSCAASGSRVSFLSMAWYRQAPG KKRELVAGISADGSTSYIDSVKGRFTISRDNAKNSVYLQMNSLR AEDTAVYYCYAYRWRTRYTYWGQGTLVTVSS |
| Exemplary anti-target (DLL3) (SEQ ID NO: 586) | EVQLVESGGGLVQPGGSLTLSCAASKSSVSFLSMAWYRQAPGK KRELVAGISADGSTDYIDSVKGRFTISRDNAKNSVYLQMNSLRA EDTAVYYCYAYRWTTRATYWGQGTLVTVSS |
| Exemplary anti-target (DLL3) (SEQ ID NO: 587) | EVQLVESGGGLVQPGGSLTLSCAASGSSVSFLSMAWYRQAPG KKRELVAGISADGSTAYIDSVKGRFTISRDNAKNSVYLQMNSLR AEDTAVYYCYAYRWTTRRTYWGQGTLVTVSS |
| Exemplary anti-target (DLL3) (SEQ ID NO: 588) | EVQLVESGGGLVQPGGSLTLSCAASGSSVKFLSMAWYRQAPG KKRELVAGISADGSTVYIDSVKGRFTISRDNAKNSVYLQMNSLR AEDTAVYYCYAYRWPTRYTYWGQGTLVTVSS |
| Exemplary anti-target (DLL3) (SEQ ID NO: 589) | EVQLVESGGGLVQPGGSLTLSCAASGSSVRFLSMAWYRQAPG KKRELVAGISQDGSTDYIDSVKGRFTISRDNAKNSVYLQMNSLR AEDTAVYYCYAYRWRTRYTYWGQGTLVTVSS |
| Exemplary anti-target (DLL3) (SEQ ID NO: 590) | EVQLVESGGGLVQPGGSLTLSCAASGSSVRFLSMAWYRQAPG KKRELVAGISNDGSTDYIDSVKGRFTISRDNAKNSVYLQMNSLR AEDTAVYYCYAYRWKTRYTYWGQGTLVTVSS |
| Exemplary anti-target (DLL3) (SEQ ID NO: 591) | EVQLVESGGGLVQPGGSLTLSCAASGSRVSFLSMAWYRQAPG KKRELVAGISARGSTDYIDSVKGRFTISRDNAKNSVYLQMNSLR AEDTAVYYCYAYRWSTRYTYWGQGTLVTVSS |
| Exemplary anti-target (DLL3) (SEQ ID NO: 592) | EVQLVESGGGLVQPGGSLTLSCAASGSSVSFLSLAWYRQAPGK KRELVAGISADGSTDYIDSVKGRFTISRDNAKNSVYLQMNSLRA EDTAVYYCYAYRWKTRRTYWGQGTLVTVSS |
| Exemplary anti-target (DLL3) (SEQ ID NO: 593) | EVQLVESGGGLVQPGGSLTLSCAASGSSVRFLSMAWYRQAPG KKRELVAGISRDGSTDYIDSVKGRFTISRDNAKNSVYLQMNSLR AEDTAVYYCYAYRWTTRRTYWGQGTLVTVSS |
| Exemplary anti-target (DLL3) (SEQ ID NO: 594) | EVQLVESGGGLVQPGGSLTLSCAASGSKVSFLSMAWYRQAPG KKRELVAGISADGSTLYIDSVKGRFTISRDNAKNSVYLQMNSLR AEDTAVYYCYAYRWTTRYRYWGQGTLVTVSS |
| Exemplary anti-target (DLL3) (SEQ ID NO: 595) | EVQLVESGGGLVQPGGSLTLSCAASGSSVSFLSMAWYRQAPG KKRELVAGISADGSTNYIDSVKGRFTISRDNAKNSVYLQMNSLR AEDTAVYYCYAYRWRTRYTYWGQGTLVTVSS |

| SEQUENCE TABLE | |
|---|---|
| DESCRIPTION | SEQUENCE |
| Exemplary anti-target (DLL3) (SEQ ID NO: 596) | EVQLVESGGGLVQPGGSLTLSCAASGSSVRFLSMAWYRQAPG KKRELVAGISADGSTVYIDSVKGRFTISRDNAKNSVYLQMNSLR AEDTAVYYCYAYRWTTRYKYWGQGTLVTVSS |
| Exemplary anti-target (DLL3) (SEQ ID NO: 597) | EVQLVESGGGLVQPGGSLTLSCAASGSKVSFLSMAWYRQAPG KKRELVAGISADGSTTYIDSVKGRFTISRDNAKNSVYLQMNSLR AEDTAVYYCYAYRWKTRYTYWGQGTLVTVSS |
| Exemplary anti-target (DLL3) (SEQ ID NO: 598) | EVQLVESGGGLVQPGGSLTLSCAASGSSVKFLSMAWYRQAPG KKRELVAGISADGSTDYIGSVKGRFTISRDNAKNSVYLQMNSLR AEDTAVYYCYAYRWTTRVTYWGQGTLVTVSS |
| Exemplary anti-target (DLL3) (SEQ ID NO: 599) | EVQLVESGGGLVQPGGSLTLSCAASGSSVKFLSMAWYRQAPG KKRELVAGISRDGSTDYIDSVKGRFTISRDNAKNSVYLQMNSLR AEDTAVYYCYAYRWTTRFTYWGQGTLVTVSS |
| Exemplary anti-target (DLL3) (SEQ ID NO: 600) | EVQLVESGGGLVQPGGSLTLSCAASGSRVSFLSMAWYRQAPG KKRELVAGISADGSTTYIDSVKGRFTISRDNAKNSVYLQMNSLR AEDTAVYYCYAYRWTTRFTYWGQGTLVTVSS |
| Exemplary anti-target (DLL3) (SEQ ID NO: 601) | EVQLVESGGGLVQPGGSLTLSCAASGSSVLFLSMAWYRQAPG KKRELVAGVSSDGSTDYIDSVKGRFTISRDNAKNSVYLQMNSLR AEDTAVYYCYAYRWRTRYTYWGQGTLVTVSS |
| Exemplary anti-target (DLL3) (SEQ ID NO: 602) | EVQLVESGGGLVQPGGSLTLSCAASGSRVSFLSMAWYRQAPG KKRELVAGISADGHTDYIDSVKGRFTISRDNAKNSVYLQMNSLR AEDTAVYYCYAYRWTTRYTHWGQGTLVTVSS |
| Exemplary anti-target (DLL3) (SEQ ID NO: 603) | EVQLVESGGGLVQPGGSLTLSCAASGSRVSFLSMAWYRQAPG KKRELVAGISADGSTDYFDSVKGRFTISRDNAKNSVYLQMNSLR AEDTAVYYCYAYRWTRRYTYWGQGTLVTVSS |
| Exemplary anti-target (DLL3) (SEQ ID NO: 604) | EVQLVESGGGLVQPGGSLTLSCAASGSSVGFLSMAWYRQAPG KKRELVAGISADGSTVYIDSVKGRFTISRDNAKNSVYLQMNSLR AEDTAVYYCYAYRWTTRYTYWGQGTLVTVSS |
| Exemplary anti-target (DLL3) (SEQ ID NO: 605) | EVQLVESGGGLVQPGGSLTLSCAASGSSVSFMSMAWYRQAP GKKRELVAGISADGSTDYIASVKGRFTISRDNAKNSVYLQMNSL RAEDTAVYYCYAYRWTTRSTYWGQGTLVTVSS |
| Exemplary anti-target (DLL3) (SEQ ID NO: 606) | EVQLVESGGGLVQPGGSLTLSCAASGSSVSFLSMAWYRQAPG KKRELVAGISADGSTDYISSVKGRFTISRDNAKNSVYLQMNSLR AEDTAVYYCYAYSWTTRYTYWGQGTLVTVSS |
| Exemplary anti-target (DLL3) (SEQ ID NO: 607) | EVQLVESGGGLVQPGGSLTLSCAASGSSVTFLSMAWYRQAPG KKRELVAGISADGSTVYIDSVKGRFTISRDNAKNSVYLQMNSLR AEDTAVYYCYAYRWTTRGTYWGQGTLVTVSS |
| Exemplary anti-target (DLL3) (SEQ ID NO: 608) | EVQLVESGGGLVQPGGSLTLSCAASGSSVRFLSMAWYRQAPG KKRELVAGISADGSTVYIDSVKGRFTISRDNAKNSVYLQMNSLR AEDTAVYYCYAYRWKTRYTYWGQGTLVTVSS |
| Exemplary anti-target (DLL3) (SEQ ID NO: 609) | EVQLVESGGGLVQPGGSLTLSCAASGSKVSFLSMAWYRQAPG KKRELVAGISADGSTTYIDSVKGRFTISRDNAKNSVYLQMNSLR AEDTAVYYCYAYRWTTRFTYWGQGTLVTVSS |
| Exemplary anti-target (DLL3) (SEQ ID NO: 610) | EVQLVESGGGLVQPGGSLTLSCAASGSKVSFMSMAWYRQAP GKKRELVAGISVDGSTDYIDSVKGRFTISRDNAKNSVYLQMNSL RAEDTAVYYCYAYRWRTRYTYWGQGTLVTVSS |
| Exemplary anti-target (DLL3) (SEQ ID NO: 611) | EVQLVESGGGLVQPGGSLTLSCAASGSSVSNLSMAWYRQAPG KKRELVAGISADGSTAYIDSVKGRFTISRDNAKNSVYLQMNSLR AEDTAVYYCYAYRWTTRRTYWGQGTLVTVSS |
| Exemplary anti-target (DLL3) (SEQ ID NO: 612) | EVQLVESGGGLVQPGGSLTLSCAASNSSVSKLSMAWYRQAPG KKRELVAGISADGSTAYIDSVKGRFTISRDNAKNSVYLQMNSLR AEDTAVYYCYAYRWSTRYTYWGQGTLVTVSS |
| Exemplary anti-target (DLL3) (SEQ ID NO: 613) | EVQLVESGGGLVQPGGSLTLSCAASGSKVSFLSMAWYRQAPG KKRELVAGISADGSKDYIDSVKGRFTISRDNAKNSVYLQMNSLR AEDTAVYYCYAYRWTTRLTYWGQGTLVTVSS |

SEQUENCE TABLE

| DESCRIPTION | SEQUENCE |
| --- | --- |
| Exemplary anti-target (DLL3) (SEQ ID NO: 614) | EVQLVESGGGLVQPGGSLTLSCVASGSQVSFLSMAWYRQAPG KKRELVAGISADGSTDYFDSVKGRFTISRDNAKNSVYLQMNSLR AEDTAVYYCYAYRWTRRYTYWGQGTLVTVSS |
| Exemplary anti-target (DLL3) (SEQ ID NO: 615) | EVQLVESGGGLVQPGGSLTLSCAASGSKVSFMSMAWYRQAP GKKRELVAGISADGSTDYIDSVKGRFTISRDNAKNSVYLQMNSL RAEDTAVYYCYAYRWTTRLTYWGQGTLVTVSS |
| Exemplary anti-target (DLL3) (SEQ ID NO: 616) | EVQLVESGGGLVQPGGSLTLSCAASGSRVSFLSMAWYRQAPG KKRELVAGISADGSTVYIDSVKGRFTISRDNAKNSVYLQMNSLR AEDTAVYYCYAYRWTRRYTYWGQGTLVTVSS |
| Exemplary anti-target (DLL3) (SEQ ID NO: 617) | EVQLVESGGGLVQPGGSLTLSCAASGSSVRFLSMAWYRQAPG KKRELVAGISADGSTVYIDSVKGRFTISRDNAKNSVYLQMNSLR AEDTAVYYCYAYRWTTRRTYWGQGTLVTVSS |
| Exemplary anti-target (DLL3) (SEQ ID NO: 618) | EVQLVESGGGLVQPGGSLTLSCAASGSKVSFLSMAWYRQAPG KKRELVAGISARGSTDYIDSVKGRFTISRDNAKNSVYLQMNSLR AEDTAVYYCYAYQWTTRYTYWGQGTLVTVSS |
| Exemplary anti-target (DLL3) (SEQ ID NO: 619) | EVQLVESGGGLVQPGGSLTLSCAASGSSVRFLSMAWYRQAPG KKRELVAGISATGSTDYIDSVKGRFTISRDNAKNSVYLQMNSLR AEDTAVYYCYAYRWTRRYTYWGQGTLVTVSS |
| Exemplary anti-target (DLL3) (SEQ ID NO: 620) | EVQLVESGGGLVQPGGSLTLSCAASGSSVSFLSIAWYRQAPGK KRELVAGISKDGSTDYIDSVKGRFTISRDNAKNSVYLQMNSLRA EDTAVYYCYAYRWTTRMTYWGQGTLVTVSS |
| Exemplary anti-target (DLL3) (SEQ ID NO: 621) | EVQLVESGGGLVQPGGSLTLSCAASGSSSSFLSMAWYRQAPGK KRELVAGISADGSTVYIDSVKGRFTISRDNAKNSVYLQMNSLRA EDTAVYYCYAYRWTTRRTYWGQGTLVTVSS |
| Exemplary anti-target (DLL3) (SEQ ID NO: 622) | EVQLVESGGGLVQPGGSLTLSCAASGSSVKFLSMAWYRQAPG KKRELVAGISPDGSTDYIDSVKGRFTISRDNAKNSVYLQMNSLR AEDTAVYYCYAYRWTTRYRYWGQGTLVTVSS |
| Exemplary anti-target (DLL3) (SEQ ID NO: 623) | EVQLVESGGGLVQPGGSLTLSCAASGSSVNFLSMAWYRQAPG KKRELVAGISADGSTHYIDSVKGRFTISRDNAKNSVYLQMNSLR AEDTAVYYCYAYRWLTRYTYWGQGTLVTVSS |
| Exemplary anti-target (DLL3) (SEQ ID NO: 624) | EVQLVESGGGLVQPGGSLTLSCAASGSSVKFLSMAWYRQAPG KKRELVAGISADGSTDYILSVKGRFTISRDNAKNSVYLQMNSLR AEDTAVYYCYAYEWTTRYTYWGQGTLVTVSS |
| Exemplary anti-target (DLL3) (SEQ ID NO: 625) | EVQLVESGGGLVQPGGSLTLSCAASGSSVSFLSMAWYRQAPG KKRELVAGISADGSTDYIHSVKGRFTISRDNAKNSVYLQMNSLR AEDTAVYYCYAYRWRTRYTYWGQGTLVTVSS |
| Exemplary anti-target (DLL3) (SEQ ID NO: 626) | EVQLVESGGGLVQPGGSLTLSCAASGSSVRFLSMAWYRQAPG KKRELVAGISVDGSTDYIDSVKGRFTISRDNAKNSVYLQMNSLR AEDTAVYYCYAYRWRTRYTYWGQGTLVTVSS |
| Exemplary anti-target (DLL3) (SEQ ID NO: 627) | EVQLVESGGGLVQPGGSLTLSCAASGSSVSFLSVAWYRQAPGK KRELVAGISRDGSTDYIDSVKGRFTISRDNAKNSVYLQMNSLRA EDTAVYYCYAYRWRTRYTYWGQGTLVTVSS |
| Exemplary anti-target (DLL3) (SEQ ID NO: 628) | EVQLVESGGGLVQPGGSLTLSCAASGSQVSFLSMAWYRQAPG KKRELVAGISADGSTVYIDSVKGRFTISRDNAKNSVYLQMNSLR AEDTAVYYCYAYRWSTRYTYWGQGTLVTVSS |
| Exemplary anti-target (DLL3) (SEQ ID NO: 629) | EVQLVESGGGLVQPGGSLTLSCAASGTSVSFLSMAWYRQAPG KKRELVAGISADGSTDYIRSVKGRFTISRDNAKNSVYLQMNSLR AEDTAVYYCYAYRWTTRLTYWGQGTLVTVSS |
| Exemplary anti-target (DLL3) (SEQ ID NO: 630) | EVQLVESGGGLVQPGGSLTLSCAASGSRVSFLSMAWYRQAPG KKRELVAGISADGSTMYIDSVKGRFTISRDNAKNSVYLQMNSLR AEDTAVYYCYAYRWTTRLTYWGQGTLVTVSS |
| Exemplary anti-target (DLL3) (SEQ ID NO: 631) | EVQLVESGGGLVQPGGSLTLSCAASGSSVKFLSMAWYRQAPG KKRELVAGISTDGSTDYIDSVKGRFTISRDNAKNSVYLQMNSLR AEDTAVYYCYAYKWTTRYTYWGQGTLVTVSS |

SEQUENCE TABLE

| DESCRIPTION | SEQUENCE |
| --- | --- |
| Exemplary anti-target (DLL3) (SEQ ID NO: 632) | EVQLVESGGGLVQPGGSLTLSCAASGSSVSFLSSAWYRQAPGK KRELVAGISADGSTLYIDSVKGRFTISRDNAKNSVYLQMNSLRA EDTAVYYCYAYRWTTRSTYWGQGTLVTVSS |
| Exemplary anti-target (DLL3) (SEQ ID NO: 633) | EVQLVESGGGLVQPGGSLTLSCAASGSSVKFLSMAWYRQAPG KKRELVAGISADGSTDYIDSVKGRFTISRDNAKNSVYLQMNSLR AEDTAVYYCYAYRWRTRYTYWGQGTLVTVSS |
| Exemplary anti-target (DLL3) (SEQ ID NO: 634) | EVQLVESGGGLVQPGGSLTLSCAASGSSVSFLSMAWYRQAPG KKRELVAGISATGSTDYIDSVKGRFTISRDNAKNSVYLQMNSLR AEDTAVYYCYAYRWSTRYTYWGQGTLVTVSS |
| Exemplary anti-target (DLL3) (SEQ ID NO: 635) | EVQLVESGGGLVQPGGSLTLSCAASGSTVSFLSMAWYRQAPG KKRELVAGISHDGSTDYIDSVKGRFTISRDNAKNSVYLQMNSLR AEDTAVYYCYAYRWTTRYTYWGQGTLVTVSS |
| Exemplary anti-target (DLL3) (SEQ ID NO: 636) | EVQLVESGGGLVQPGGSLTLSCAASGSSVQFLSMAWYRQAPG KKRELVAGISYDGSTDYIDSVKGRFTISRDNAKNSVYLQMNSLR AEDTAVYYCYAYRWRTRYTYWGQGTLVTVSS |
| Exemplary anti-target (DLL3) (SEQ ID NO: 637) | EVQLVESGGGLVQPGGSLTLSCAASRSSVSFLSMAWYRQAPG KKRELVAGISTDGSTDYIDSVKGRFTISRDNAKNSVYLQMNSLR AEDTAVYYCYAYRWLTRYTYWGQGTLVTVSS |
| Exemplary anti-target (DLL3) (SEQ ID NO: 638) | EVQLVESGGGLVQPGGSLTLSCAASGSKVSFLSMAWYRQAPG KKRELVAGISADGSTAYIDSVKGRFTISRDNAKNSVYLQMNSLR AEDTAVYYCYAYRWRTRYTYWGQGTLVTVSS |
| Exemplary anti-target (DLL3) (SEQ ID NO: 639) | EVQLVESGGGLVQPGGSLTLSCAASGSRVSFLSMAWYRQAPG KKRELVAGISADGSTDYIESVKGRFTISRDNAKNSVYLQMNSLR AEDTAVYYCYAYRWTTRYTYWGQGTLVTVSS |
| Exemplary anti-target (DLL3) (SEQ ID NO: 640) | EVQLVESGGGLVQPGGSLTLSCAASGSSVSFLSMAWYRQAPG KKRELVAGISIDGSTDYIKSVKGRFTISRDNAKNSVYLQMNSLRA EDTAVYYCYAYRWTTRYRYWGQGTLVTVSS |
| Exemplary anti-target (DLL3) (SEQ ID NO: 641) | EVQLVESGGGLVQPGGSLTLSCAASGSKVSFLSMAWYRQAPG KKRELVAGISADGSKDYIDSVKGRFTISRDNAKNSVYLQMNSLR AEDTAVYYCYAYRWTTRYTYWGQGTLVTVSS |
| Exemplary anti-target (DLL3) (SEQ ID NO: 642) | EVQLVESGGGLVQPGGSLTLSCAASGSSVRFLSMAWYRQAPG KKRELVAGISADGSTVYIDSVKGRFTISRDNAKNSVYLQMNSLR AEDTAVYYCYAYRWPTRYTYWGQGTLVTVSS |
| Exemplary anti-target (DLL3) (SEQ ID NO: 643) | EVQLVESGGGLVQPGGSLTLSCAASGSSVKFLSMAWYRQAPG KKRELVAGISRDGSTDYIDSVKGRFTISRDNAKNSVYLQMNSLR AEDTAVYYCYAYRWTTRHTYWGQGTLVTVSS |
| Exemplary anti-target (DLL3) (SEQ ID NO: 644) | EVQLVESGGGLVQPGGSLTLSCAASGSSVKFLSMAWYRQAPG KKRELVAGISADGSTDYIHSVKGRFTISRDNAKNSVYLQMNSLR AEDTAVYYCYAYRWTRRYTYWGQGTLVTVSS |
| Exemplary anti-target (DLL3) (SEQ ID NO: 645) | EVQLVESGGGLVQPGGSLTLSCAASGSSVSILSMAWYRQAPGK KRELVAGISADGSTIYIDSVKGRFTISRDNAKNSVYLQMNSLRAE DTAVYYCYAYRWHTRYTYWGQGTLVTVSS |
| Exemplary anti-target (DLL3) (SEQ ID NO: 646) | EVQLVESGGGLVQPGGSLTLSCAASGSSVSFLSVAWYRQAPGK KRELVAGISANGSTDYIDSVKGRFTISRDNAKNSVYLQMNSLRA EDTAVYYCYAYRWTNRYTYWGQGTLVTVSS |
| Exemplary anti-target (DLL3) (SEQ ID NO: 647) | EVQLVESGGGLVQPGGSLTLSCAASGSSVRFLSMAWYRQAPG KKRELVAGISTDGSTDYIDSVKGRFTISRDNAKNSVYLQMNSLR AEDTAVYYCYAYRWTTRYRYWGQGTLVTVSS |
| Exemplary anti-target (DLL3) (SEQ ID NO: 648) | EVQLVESGGGLVQPGGSLTLSCAASGSRVSFLSMAWYRQAPG KKRELVAGISYDGSTDYIDSVKGRFTISRDNAKNSVYLQMNSLR AEDTAVYYCYAYRWTTRRTYWGQGTLVTVSS |
| Exemplary anti-target (DLL3) (SEQ ID NO: 649) | EVQLVESGGGLVQPGGSLTLSCAASGHSVSFLSMAWYRQAPG KKRELVAGISADGSTDYIASVKGRFTISRDNAKNSVYLQMNSLR AEDTAVYYCYAYRWSTRYTYWGQGTLVTVSS |

SEQUENCE TABLE

| DESCRIPTION | SEQUENCE |
| --- | --- |
| Exemplary anti-target (DLL3) (SEQ ID NO: 650) | EVQLVESGGGLVQPGGSLTLSCAASGSSVRFLSMAWYRQAPG KKRELVAGISADGSTDYIGSVKGRFTISRDNAKNSVYLQMNSLR AEDTAVYYCYAYRWSTRYTYWGQGTLVTVSS |
| Exemplary anti-target (DLL3) (SEQ ID NO: 651) | EVQLVESGGGLVQPGGSLTLSCAASGSSVSFLSMAWYRQAPG KKRELVAGISANGSTDYYDSVKGRFTISRDNAKNSVYLQMNSLR AEDTAVYYCYAYRWRTRYTYWGQGTLVTVSS |
| Exemplary anti-target (DLL3) (SEQ ID NO: 652) | EVQLVESGGGLVQPGGSLTLSCAASGSRVSFLSMAWYRQAPG KKRELVAGISADGSTSYIDSVKGRFTISRDNAKNSVYLQMNSLR AEDTAVYYCYAYRWTTRYTYWGQGTLVTVSS |
| Exemplary anti-target (DLL3) (SEQ ID NO: 653) | EVQLVESGGGLVQPGGSLTLSCAASGSSVKFLSMAWYRQAPG KKRELVAGVSADGSTDYIDSVKGRFTISRDNAKNSVYLQMNSL RAEDTAVYYCYAYEWTTRYTYWGQGTLVTVSS |
| Exemplary anti-target (DLL3) (SEQ ID NO: 654) | EVQLVESGGGLVQPGGSLTLSCAASGSSVSRLSMAWYRQAPG KKRELVAGISARGSTDYIDSVKGRFTISRDNAKNSVYLQMNSLR AEDTAVYYCYAYRWTTRSTYWGQGTLVTVSS |
| Exemplary anti-target (DLL3) (SEQ ID NO: 655) | EVQLVESGGGLVQPGGSLTLSCAASGRSVSFLSMAWYRQAPG KKRELVAGISADGSTIYIDSVKGRFTISRDNAKNSVYLQMNSLRA EDTAVYYCYAYRWTTRYTYWGQGTLVTVSS |
| Exemplary anti-target (DLL3) (SEQ ID NO: 656) | EVQLVESGGGLVQPGGSLTLSCAASGRSVSFLSMAWYRQAPG KKRELVAGISANGSTDYIDSVKGRFTISRDNAKNSVYLQMNSLR AEDTAVYYCYAYRWSTRYTYWGQGTLVTVSS |
| Exemplary anti-target (DLL3) (SEQ ID NO: 657) | EVQLVESGGGLVQPGGSLTLSCAASGSSVKFLSMAWYRQAPG KKRELVAGISADGSTDYVDSVKGRFTISRDNAKNSVYLQMNSL RAEDTAVYYCYAYRWSTRYTYWGQGTLVTVSS |
| Exemplary anti-target (DLL3) (SEQ ID NO: 658) | EVQLVESGGGLVQPGGSLTLSCAASGSSVSKLSMAWYRQAPG KKRELVAGISADGSTDYRDSVKGRFTISRDNAKNSVYLQMNSLR AEDTAVYYCYAYRWTYRYTYWGQGTLVTVSS |
| Exemplary anti-target (DLL3) (SEQ ID NO: 659) | EVQLVESGGGLVQPGGSLTLSCAASGSSVSRLSMAWYRQAPG KKRELVAGISVDGSTDYIDSVKGRFTISRDNAKNSVYLQMNSLR AEDTAVYYCYAYRWTTRLTYWGQGTLVTVSS |
| Exemplary anti-target (DLL3) (SEQ ID NO: 660) | EVQLVESGGGLVQPGGSLTLSCAASGSSVKFLSLAWYRQAPGK KRELVAGISADGSTDYILSVKGRFTISRDNAKNSVYLQMNSLRA EDTAVYYCYAYEWTTRYTYWGQGTLVTVSS |
| Exemplary anti-target (DLL3) (SEQ ID NO: 661) | EVQLVESGGGLVQPGGSLTLSCAASGSSVSRLSLAWYRQAPGK KRELVAGISVDGSTDYIDSVKGRFTISRDNAKNSVYLQMNSLRA EDTAVYYCYAYRWTTRLTYWGQGTLVTVSS |
| Exemplary anti-target (DLL3) (SEQ ID NO: 662) | EVQLVESGGGLVQPGGSLTLSCVASGTSSSINAMGWYRRAPG KQRELVAGISSDGSKVFNESVKGRFTISRDNAKNSVYLQMNSLR AEDTAVYYCYYFRPAAGSPMRYWGQGTLVTVSS |
| Exemplary anti-target (DLL3) (SEQ ID NO: 663) | EVQLVESGGGLVQPGGSLTLSCVASGTTSSINAIGWYRRAPGK QRELVAGISSDGSEVYTDSVKGRFTISRDNAKNSVYLQMNSLRA EDTAVYYCYYFRTVDGSPLRYWGQGTLVTVSS |
| Exemplary anti-target (DLL3) (SEQ ID NO: 664) | EVQLVESGGGLVQPGGSLTLSCVASGSTSSINAMAWYRRAPG KQRELVAGISSDDSNVYYESVKGRFTISRDNAKNSVYLQMNSLR AEDTAVYYCYYFRTVSGSSKRYWGQGTLVTVSS |
| Exemplary anti-target (DLL3) (SEQ ID NO: 665) | EVQLVESGGGLVQPGGSLTLSCVASGQTYRVNAFGWYRRAPG KQRELVAGISSDGSKVYADSVKGRFTISRDNAKNSVYLQMNSL RAEDTAVYYCYYFSAGSGTEMSYWGQGTLVTVSS |
| Exemplary anti-target (DLL3) (SEQ ID NO: 666) | EVQLVESGGGLVQPGGSLTLSCVASGSTSSINAMAWYRRAPG KQRELVAGISSDESTLYVDSVKGRFTISRDNAKNSVYLQMNSLR AEDTAVYYCYYFGSLSGSSTTYWGQGTLVTVSS |
| Exemplary anti-target (DLL3) (SEQ ID NO: 667) | EVQLVESGGGLVQPGGSLTLSCVASGSASLTNATGWYRRAPGK QRELVAGISSDDSKVYSDSVKGRFTISRDNAKNSVYLQMNSLRA EDTAVYYCYYFGSVSGSWTRYWGQGTLVTVSS |

-continued

SEQUENCE TABLE

| DESCRIPTION | SEQUENCE |
|---|---|
| Exemplary anti-target (DLL3) (SEQ ID NO: 668) | EVQLVESGGGLVQPGGSLTLSCVASGYPSLNNAMGWYRRAPG KQRELVAGISSDGSQVYGASVKGRFTISRDNAKNSVYLQMNSL RAEDTAVYYCYYFRLVSGSSMSYWGQGTLVTVSS |
| Exemplary anti-target (DLL3) (SEQ ID NO: 669) | EVQLVESGGGLVQPGGSLTLSCVASGSSSTINAIGWYRRAPGK QRELVAGISSDGSKVYADSVKGRFTISRDNAKNSVYLQMNSLR AEDTAVYYCYYFRTGSGTSKSYWGQGTLVTVSS |
| Exemplary anti-target (DLL3) (SEQ ID NO: 670) | EVQLVESGGGLVQPGGSLTLSCVASGSTSYINAMGWYRRAPG KQRELVAGISSDGSNMYADSVKGRFTISRDNAKNSVYLQMNSL RAEDTAVYYCYYFSNMSGTTRRYWGQGTLVTVSS |
| Exemplary anti-target (DLL3) (SEQ ID NO: 671) | EVQLVESGGGLVQPGGSLTLSCVASGSTSSVNALGWYRRAPGK QRELVAGISSDGSKVYTDSVKGRFTISRDNAKNSVYLQMNSLR AEDTAVYYCYYFRTVPGSAMGYWGQGTLVTVSS |
| Exemplary anti-target (DLL3) (SEQ ID NO: 672) | EVQLVESGGGLVQPGGSLTLSCVASGSTSLSNAVGWYRRAPGK QRELVAGISSDGSKVSAESVKGRFTISRDNAKNSVYLQMNSLRA EDTAVYYCYYFRAESGSSMGYWGQGTLVTVSS |
| Exemplary anti-target (DLL3) (SEQ ID NO: 673) | EVQLVESGGGLVQPGGSLTLSCVASGSTSSTNAIGWYRRAPGK QRELVAGISSDGSKVYDDSVKGRFTISRDNAKNSVYLQMNSLR AEDTAVYYCYYFRTLYGSSRSYWGQGTLVTVSS |
| Exemplary anti-target (DLL3) (SEQ ID NO: 674) | EVQLVESGGGLVQPGGSLTLSCVASGLTSTINAMGWYRRAPG KQRELVAGISSDGSKVYDDSVKGRFTISRDNAKNSVYLQMNSL RAEDTAVYYCYYFSPFSGSDTGYWGQGTLVTVSS |
| Exemplary anti-target (DLL3) (SEQ ID NO: 675) | EVQLVESGGGLVQPGGSLTLSCVASGVSPSKNAIGWYRRAPGK QRELVAGISSDGSAVYGSVKGRFTISRDNAKNSVYLQMNSLR AEDTAVYYCYYFSTFSGSSISYWGQGTLVTVSS |
| Exemplary anti-target (DLL3) (SEQ ID NO: 676) | EVQLVESGGGLVQPGGSLTLSCVASGSTSSINAVGWYRRAPGK QRELVAGISSDGSYVYSESVKGRFTISRDNAKNSVYLQMNSLRA EDTAVYYCYYFRTLAGSEMRYWGQGTLVTVSS |
| Exemplary anti-target (DLL3) (SEQ ID NO: 677) | EVQLVESGGGLVQPGGSLTLSCVASGSTTMNNAMAWYRRAP GKQRELVAGISSDSSHVYADSVKGRFTISRDNAKNSVYLQMNS LRAEDTAVYYCYYFRTVSGSGVRYWGQGTLVTVSS |
| Exemplary anti-target (DLL3) (SEQ ID NO: 678) | EVQLVESGGGLVQPGGSLTLSCVASGSTSKINAIGWYRRAPGK QRELVAGISSDSSIVYTDSVKGRFTISRDNAKNSVYLQMNSLRA EDTAVYYCYYFRPGAGHSNSYWGQGTLVTVSS |
| Exemplary anti-target (DLL3) (SEQ ID NO: 679) | EVQLVESGGGLVQPGGSLTLSCVASGQTTALNAMGWYRRAP GKQRELVAGISSDGSEVNTDSVKGRFTISRDNAKNSVYLQMNS LRAEDTAVYYCYYFRRASGTAMSYWGQGTLVTVSS |
| Exemplary anti-target (DLL3) (SEQ ID NO: 680) | EVQLVESGGGLVQPGGSLTLSCVASGATSSINAIGWYRRAPGK QRELVAGISSDGSKLSSDSVKGRFTISRDNAKNSVYLQMNSLRA EDTAVYYCYYFTSASGTDLSYWGQGTLVTVSS |
| Exemplary anti-target (DLL3) (SEQ ID NO: 681) | EVQLVESGGGLVQPGGSLTLSCVASGSTSTINAMGWYRRAPG KQRELVAGISSDNSKVYADSVKGRFTISRDNAKNSVYLQMNSL RAEDTAVYYCYYFRSANGSSKRYWGQGTLVTVSS |
| Exemplary anti-target (DLL3) (SEQ ID NO: 682) | EVQLVESGGGLVQPGGSLTLSCVASGSTSSINAMGWYRRAPG KQRELVAGISSDGSRVYFDSVKGRFTISRDNAKNSVYLQMNSLR AEDTAVYYCYYFKTIAGAGMRYWGQGTLVTVSS |
| Exemplary anti-target (DLL3) (SEQ ID NO: 683) | EVQLVESGGGLVQPGGSLTLSCVASGSTSLVNAMGWYRRAPG KQRELVAGISSDGSLVYAESVKGRFTISRDNAKNSVYLQMNSLR AEDTAVYYCYYFRYGSGSSLSYWGQGTLVTVSS |
| Exemplary anti-target (DLL3) (SEQ ID NO: 684) | EVQLVESGGGLVQPGGSLTLSCVASGSTSLNNAIGWYRRAPGK QRELVAGISSDGSVVYVDSVKGRFTISRDNAKNSVYLQMNSLR AEDTAVYYCYYFRTVPGASMKYWGQGTLVTVSS |
| Exemplary anti-target (DLL3) (SEQ ID NO: 685) | EVQLVESGGGLVQPGGSLTLSCVASGSTSPVNAMAWYRRAPG KQRELVAGISSDGSKVYVDSVKGRFTISRDNAKNSVYLQMNSL RAEDTAVYYCYYFRTVDGSAISYWGQGTLVTVSS |

SEQUENCE TABLE

| DESCRIPTION | SEQUENCE |
|---|---|
| Exemplary anti-target (DLL3) (SEQ ID NO: 686) | EVQLVESGGGLVQPGGSLTLSCVASGTTSSMNAIGWYRRAPG<br>KQRELVAGISSDGSKLYDESVKGRFTISRDNAKNSVYLQMNSLR<br>AEDTAVYYCYYFRTVKGSGGSYWGQGTLVTVSS |
| Exemplary anti-target (DLL3) (SEQ ID NO: 687) | EVQLVESGGGLVQPGGSLTLSCVASGETSSINAMAWYRRAPG<br>KQRELVAGISSDYSKLYADSVKGRFTISRDNAKNSVYLQMNSLR<br>AEDTAVYYCYYFRTVSGSSRGYWGQGTLVTVSS |
| Exemplary anti-target (DLL3) (SEQ ID NO: 688) | EVQLVESGGGLVQPGGSLTLSCVASGSTSTINAIGWYRRAPGK<br>QRELVAGISSDSSKVYTESVKGRFTISRDNAKNSVYLQMNSLRA<br>EDTAVYYCYYFRPGPGSQMAYWGQGTLVTVSS |
| Exemplary anti-target (DLL3) (SEQ ID NO: 689) | EVQLVESGGGLVQPGGSLTLSCVASGSTYSMNAMGWYRRAP<br>GKQRELVAGISSDGSQVYVDSVKGRFTISRDNAKNSVYLQMNS<br>LRAEDTAVYYCYYFRTVAGSASGYWGQGTLVTVSS |
| Exemplary anti-target (DLL3) (SEQ ID NO: 690) | EVQLVESGGGLVQPGGSLTLSCVASGSPSSINAYGWYRRAPGK<br>QRELVAGISSDGSKVYSDSVKGRFTISRDNAKNSVYLQMNSLRA<br>EDTAVYYCYYFRTVSGSSYSYWGQGTLVTVSS |
| Exemplary anti-target (DLL3) (SEQ ID NO: 691) | EVQLVESGGGLVQPGGSLTLSCVASGSTSTINAIGWYRRAPGK<br>QRELVAGISSDGSKVYVDSVKGRFTISRDNAKNSVYLQMNSLR<br>AEDTAVYYCYYFINLKGSSMAYWGQGTLVTVSS |
| Exemplary anti-target (DLL3) (SEQ ID NO: 692) | EVQLVESGGGLVQPGGSLTLSCVASGSTSSINAIGWYRRAPGK<br>QRELVAGISSDGSKVYADSVKGRFTISRDNAKNSVYLQMNSLR<br>AEDTAVYYCYYFRMVTGSYGGYWGQGTLVTVSS |
| Exemplary anti-target (DLL3) (SEQ ID NO: 693) | EVQLVESGGGLVQPGGSLTLSCVASGSISSINAMGWYRRAPGK<br>QRELVAGISSDGSSVYADSVKGRFTISRDNAKNSVYLQMNSLR<br>AEDTAVYYCYYFKSSYGLPMRYWGQGTLVTVSS |
| Exemplary anti-target (DLL3) (SEQ ID NO: 694) | EVQLVESGGGLVQPGGSLTLSCVASGSTQVNNAMAWYRRAP<br>GKQRELVAGISSDGSQVYYGSVKGRFTISRDNAKNSVYLQMNS<br>LRAEDTAVYYCYYFKTVSGQSLRYWGQGTLVTVSS |
| Exemplary anti-target (DLL3) (SEQ ID NO: 695) | EVQLVESGGGLVQPGGSLTLSCVASGSTASFNAMAWYRRAPG<br>KQRELVAGISSDGSKVYTDSVKGRFTISRDNAKNSVYLQMNSLR<br>AEDTAVYYCYYFRTVTGRAARYWGQGTLVTVSS |
| Exemplary anti-target (DLL3) (SEQ ID NO: 696) | EVQLVESGGGLVQPGGSLTLSCVASGSPLSINAIGWYRRAPGK<br>QRELVAGISSDGSKVSADSVKGRFTISRDNAKNSVYLQMNSLR<br>AEDTAVYYCYYFGPAIGASRTYWGQGTLVTVSS |
| Exemplary anti-target (DLL3) (SEQ ID NO: 697) | EVQLVESGGGLVQPGGSLTLSCVASGSTTFINAIGWYRRAPGK<br>QRELVAGISSDGSKVYEDSVKGRFTISRDNAKNSVYLQMNSLR<br>AEDTAVYYCYYFRTVSGAPKSYWGQGTLVTVSS |
| Exemplary anti-target (DLL3) (SEQ ID NO: 698) | EVQLVESGGGLVQPGGSLTLSCVASGSTSSINAIGWYRRAPGK<br>QRELVAGISSDRSKVYADSVKGRFTISRDNAKNSVYLQMNSLR<br>AEDTAVYYCYYFHTVSGSSMSYWGQGTLVTVSS |
| Exemplary anti-target (DLL3) (SEQ ID NO: 699) | EVQLVESGGGLVQPGGSLTLSCVASGETDTINAVGWYRRAPGK<br>QRELVAGISSDGSKVYAESVKGRFTISRDNAKNSVYLQMNSLRA<br>EDTAVYYCYYFRRLEGYSNRYWGQGTLVTVSS |
| Exemplary anti-target (DLL3) (SEQ ID NO: 700) | EVQLVESGGGLVQPGGSLTLSCVASGSTSPINAIGWYRRAPGK<br>QRELVAGISSDGSVVTTESVKGRFTISRDNAKNSVYLQMNSLRA<br>EDTAVYYCYYFRTGSGSSMGYWGQGTLVTVSS |
| Exemplary anti-target (DLL3) (SEQ ID NO: 701) | EVQLVESGGGLVQPGGSLTLSCVASGSITSSNAMGWYRRAPG<br>KQRELVAGISSDGSHVHQESVKGRFTISRDNAKNSVYLQMNSL<br>RAEDTAVYYCYYFTTVTGSSMSYWGQGTLVTVSS |
| Exemplary anti-target (DLL3) (SEQ ID NO: 702) | EVQLVESGGGLVQPGGSLTLSCAASRYSVSNLSMAWYRQAPG<br>KKRELVAGISADGSTVYVESVKGRFTISRDNAKNSVYLQMNSLR<br>AEDTAVYYCYAYYWTERRPYWGQGTLVTVSS |
| Exemplary anti-target (DLL3) (SEQ ID NO: 703) | EVQLVESGGGLVQPGDSLTLSCAASMSTVSVLSMAWYRQAPG<br>KKRELVAGISSDGSTVYIDSVKGRFTISRDNAKNSVYLQMNSLR<br>AEDTAIYYCYAYSWDDAHPYWGQGTLVTVSS |

SEQUENCE TABLE

| DESCRIPTION | SEQUENCE |
|---|---|
| Exemplary anti-target (DLL3) (SEQ ID NO: 704) | EVQLVESGGGLVQPGGSLTLSCAASDSYVSLLSMAWYRQAPGKKRELVAGISVDGSTHYVASVKGRFTISRDNAKNSVYLQMNSLRAEDTAVYYCYAYRWMTRLTYWGQGTLVTVSS |
| Exemplary anti-target (DLL3) (SEQ ID NO: 705) | EVQLVESGGGLVQPGGSLTLSCAASDSAVSVLSIAWYRQAPGKKRELVAGISTDGSKHYIDSVKGRFTISRDNAKNSVYLQMNSLRAEDTAVYYCYAYDWADAQPYWGQGTLVTVSS |
| Exemplary anti-target (DLL3) (SEQ ID NO: 706) | EVQLVESGGGLVQPGGSLTLSCAASHSSVTSLSLAWYRQAPGKKRELVAGISYDGSKYYAESVKGRFTISRDNAKNSVYLQMNSLRAEDTAVYYCYAYSWTDRLPYWGQGTLVTVSS |
| Exemplary anti-target (DLL3) (SEQ ID NO: 707) | EVQLVESGGGLVQPGGSLTLSCAASDSVVKFLSMAWYRQAPGKKRELVAGISANGSRTYMESVKGRFTISRDNAKNSVYLQMNSLRAEDTAVYYCYAYRWATRLPYWGQGTLVTVSS |
| Exemplary anti-target (DLL3) (SEQ ID NO: 708) | EVQLVESGGGLVQPGGSLTLSCAASDPSVWNLSMAWYRQAPGKKRELVAGISPDGSTDYVDSVKGRFTISRDNAKNSVYLQMNSLRAEDTAVYYCYAYKWSNRLPYWGQGTLVTVSS |
| Exemplary anti-target (DLL3) (SEQ ID NO: 709) | EVQLVESGGGLVQPGGSLTLSCAASGTSVMLLSLAWYRQAPGKKRELVAGISPNGSAVYTESVKGRFTISRDNAKNSVYLQMNSLRAEDTAVYYCYAYGWKTRQPYWGQGTLVTVSS |
| Exemplary anti-target (DLL3) (SEQ ID NO: 710) | EVQLVESGGGLVQPGGSLTLSCAASSSPVSNLSLAWYRQAPGKKRELVAGISPDGSTAYMESVKGRFTISRDNAKNSVYLQMNSLRAEDTAVYYCYAYRWPNRRGYWGQGTLVTVSS |
| Exemplary anti-target (DLL3) (SEQ ID NO: 711) | EVQLVESGGGLVQPGGSLTLSCAASWRSVLLLSVAWYRQAPGKKRELVAGISNDGSTDYIDSVKGRFTISRDNAKNSVYLQMNSLRAEDTAVYYCYAYDWTTRQRYWGQGTLVTVSS |
| Exemplary anti-target (DLL3) (SEQ ID NO: 712) | EVQLVESGGGLVQPGGSLTLSCAASSSSVQYLSMAWYRQAPGKKRELVAGISTDGSAVYFDSVKGRFTISRDNAKNSVYLQMNSLRAEDTAVYYCYAYNWSYAQPYWGQGTLVTVSS |
| Exemplary anti-target (DLL3) (SEQ ID NO: 713) | EVQLVESGGGLVQPGGSLTLSCAASGTSVSLLSLAWYRQAPGKKRELVAGISTGGSTHYIESVKGRFTISRDNAKNSVYLQMNSLRAEDTAVYYCYAYNWTDSLQYWGQGTLVTVSS |
| Exemplary anti-target (DLL3) (SEQ ID NO: 714) | EVQLVESGGGLVQPGGSLTLSCAASLSSVSNLSIAWYRQAPGKKRELVAGISTDGSTVYIDSVKGRFTISRDNAKNSVYLQMNSLRAEDTAVYYCYAYSWTTSLPYWGQGTLVTVSS |
| Exemplary anti-target (DLL3) (SEQ ID NO: 715) | EVQLVESGGGLVQPGGSLTLSCAASMYSVSFLSMAWYRQAPGKKRELVAGISNEGSTYYMDSVKGRFTISRDNAKNSVYLQMNSLRAEDTAVYYCYAYKWRSRSTYWGQGTLVTVSS |
| Exemplary anti-target (DLL3) (SEQ ID NO: 716) | EVQLVESGGGLVQPGGSLTLSCAASKSSVSHLSLAWYRQAPGKKRELVAGISADGSHVYTNSVKGRFTISRDNAKNSVYLQMNSLRAEDTAVYYCYAYSQTTRDPYWGQGTLVTVSS |
| Exemplary anti-target (DLL3) (SEQ ID NO: 717) | EVQLVESGGGLVQPGGSLTLSCAASYTSVLDLSIAWYRQAPGKKRELVAGISDDGSRYYTDSVKGRFTISRDNAKNSVYLQMNSLRAEDTAVYYCYAYRWTARDTYWGQGTLVTVSS |
| Exemplary anti-target (DLL3) (SEQ ID NO: 718) | EVQLVESGGGLVQPGGSLTLSCAASMSDVSFLSMAWYRQAPGKKRELVAGISAEGSTLYMESVKGRFTISRDNAKNSVYLQMNSLRAEDTAVYYCYAYRWTSRLSYWGQGTLVTVSS |
| Exemplary anti-target (DLL3) (SEQ ID NO: 719) | EVQLVESGGGLVQPGGSLTLSCAASESSVSFLSSAWYRQAPGKKRELVAGISTDGSTVYIDSVKGRFTISRDNAKNSVYLQMNSLRAEDTAVYYCYAYSWTTRSRYWGQGTLVTVSS |
| Exemplary anti-target (DLL3) (SEQ ID NO: 720) | EVQLVESGGGLVQPGGSLTLSCAASGDSVSLLSMAWYRQAPGKKRELVAGISANGSTSYIDSVKGRFTISRDNAKNSVYLQMNSLRAEDTAVYYCYAYNWTSRYRYWGQGTLVTVSS |
| Exemplary anti-target (DLL3) (SEQ ID NO: 721) | EVQLVESGGGLVQPGGSLTLSCAASGSDVWYLSLAWYRQAPGKKRELVAGISDDGSRHYIESVKGRFTISRDNAKNSVYLQMNSLRAEDTAVYYCYAYSWKTRFPYWGQGTLVTVSS |

SEQUENCE TABLE

| DESCRIPTION | SEQUENCE |
| --- | --- |
| Exemplary anti-target (DLL3) (SEQ ID NO: 722) | EVQLVESGGGLVQPGGSLTLSCAASKSAVAFLSIAWYRQAPGK KRELVAGISPDGSTVYIESVKGRFTISRDNAKNSVYLQMNSLRA EDTAVYYCYAYSWTTRYPYWGQGTLVTVSS |
| Exemplary anti-target (DLL3) (SEQ ID NO: 723) | EVQLVESGGGLVQPGGSLTLSCAASFSAVAYLSMAWYRQAPG KKRELVAGISDDGSTVYVDSVKGRFTISRDNAKNSVYLQMNSL RAEDTAVYYCYAYEWTNALPYWGQGTLVTVSS |
| Exemplary anti-target (DLL3) (SEQ ID NO: 724) | EVQLVESGGGLVQPGGSLTLSCAASVYSVYDLSTAWYRQAPGK KRELVAGISDDGSTVYFDSVKGRFTISRDNAKNSVYLQMNSLRA EDTAVYYCYAYSWITRSPYWGQGTLVTVSS |
| Exemplary anti-target (DLL3) (SEQ ID NO: 725) | EVQLVESGGGLVQPGGSLTLSCAASGDSVSFLSMAWYRQAPG KKRELVAGISDEGSTVYIGSVKGRFTISRDNAKNSVYLQMNSLR AEDTAVYYCYAYSWTTRRQYWGQGTLVTVSS |
| Exemplary anti-target (DLL3) (SEQ ID NO: 726) | EVQLVESGGGLVQPGGSLTLSCAASSSSVSLLSLAWYRQAPGKK RELVAGISDDGSIVYMDSVKGRFTISRDNAKNSVYLQMNSLRA EDTAVYYCYAYSWITRSPYWGQGTLVTVSS |
| Exemplary anti-target (DLL3) (SEQ ID NO: 727) | EVQLVESGGGLVQPGGSLTLSCAASADSVSFLSIAWYRQAPGK KRELVAGISDDGSKHYFDSVKGRFTISRDNAKNSVYLQMNSLR AEDTAVYYCYAYRWEESRQYWGQGTLVTVSS |
| Exemplary anti-target (DLL3) (SEQ ID NO: 728) | EVQLVESGGGLVQPGGSLTLSCAASASSVTLLSIAWYRQAPGKK RELVAGISTDGSTDYLHSVKGRFTISRDNAKNSVYLQMNSLRAE DTAVYYCYAYTWTTRLPYWGQGTLVTVTS |
| Exemplary anti-target (DLL3) (SEQ ID NO: 729) | EVQLVESGGGLVQPGGSLTLSCAASADSVSFLSIAWYRQAPGK KRELVAGISDDGSKHYFDSVKGRFTISRDNAKNSVYLQMNSLR AEDTAVYYCYAYRWEESRQYWGQGTLVTVSS |
| Exemplary anti-target (DLL3) (SEQ ID NO: 730) | EVQLVESGGGLVQPGGSLTLSCAASGTSVWLLSMAWYRQAP GKKRELVAGISYDGSTVYVESVKGRFTISRDNAKNSVYLQMNSL RAEDTAVYYCYAYSWTTRQPYWGQGTLVTVSS |
| Exemplary anti-target (DLL3) (SEQ ID NO: 731) | EVQLVESGGGLVQPGGSLTLSCAASGSSVSILSIAWYRQAPGKK RELVAGISDDGSTVYIDSVKGRFTISRDNAKNSVYLQMNSLRAE DTAVYYCYAYVWGTRLPYWGQGTLVTVSS |
| Exemplary anti-target (DLL3) (SEQ ID NO: 732) | EVQLVESGGGLVQPGGSLTLSCAASGTAVSNLSIAWYRQAPGK KRELVAGISDDGSTVYVDSVKGRFTISRDNAKNSVYLQMNSLR AEDTAVYYCYAYEWTNALPYWGQGTLVTVSS |
| Exemplary anti-target (DLL3) (SEQ ID NO: 733) | EVQLVESGGGLVQPGGSLTLSCAASGSAVSMLSLAWYRQAPG KKRELVAGISDDGSQVYIDSVKGRFTISRDNAKNSVYLQMNSLR AEDTAVYYCYAYRWEDALTYWGQGTLVTVSS |
| Exemplary anti-target (DLL3) (SEQ ID NO: 734) | EVQLVESGGGLVQPGGSLTLSCAASGMTVFFLSMAWYRQAP GKKRELVAGISVDGSTVYSDSVKGRFTISRDNAKNSVYLQMNSL RAEDTAVYYCYAYSWTTRYPYWGQGTLVTVSS |
| Exemplary anti-target (DLL3) (SEQ ID NO: 735) | EVQLVESGGGLVQPGGSLTLSCAASQYSVTFLSVAWYRQAPGK KRELVAGISDDGSNVYIDSVKGRFTISRDNAKNSVYLQMNSLRA EDTAVYYCYAYSWIDSLRYWGQGTLVTVSS |
| Exemplary anti-target (DLL3) (SEQ ID NO: 736) | EVQLVESGGGLVQPGGSLTLSCAASGETVSFLSLAWYRQAPGK KRELVAGISTDGSTVYFVSVKGRFTISRDNAKNSVYLQMNSLRA EDTAVYYCYAYSWTTPRAYWGQGTLVTVSS |
| Exemplary anti-target (EGFR) (SEQ ID NO: 737) | QVQLQESGGGLVQAGGSLRLSCAASGSIAYIYTMDWYRQAPG KQRELVATSTRDGNVDYAESVKGRFTISRDNAKNTVYLQMNSL KPEDTAVYYCNADLRTAVDLIRANYWGQGTQVTVSS |
| Exemplary anti-target (EGFR) (SEQ ID NO: 738) | QVQLQESGGGLVQAGDSLRLSCVVSGRTDSWYVMGWFRQA PGKDREFVAGVSWSYGNTYYADSVKGRFTASRDNAKNTAYLQ MNSLNAEDTAVYYCAARVSREVIPTRWDLYNYWGQGTQVTV SS |
| Exemplary anti-target (EGFR) (SEQ ID NO: 739) | QVQLQESGGGSVQPGGSLRVSCVVSRTIISINAMTWYHQAPG KRRELVAIITSGGETNYADSVKGRFTISRDNAKNTAYLQMNNLK PEDTGVYYCNVVPPLGSWGQGTQVTVSS |

SEQUENCE TABLE

| DESCRIPTION | SEQUENCE |
|---|---|
| Exemplary anti-target (EGFR) (SEQ ID NO: 740) | QVQLQESGGGRVQAGGSLRLSCSASARTLRLYAVGWFRQAPG<br>KEREFVAGIGRSERTYYTDSVKGRFTLSRDNAKNTVFLEMNDLE<br>PEDTAVYFCALTFQTTDMVDVPTTQHEYDYWGRGTQVTVSS |
| Exemplary anti-target (EGFR) (SEQ ID NO: 741) | QVQLQESGGGLVQAGGSLRLSCAASGSIAYIYTMDWYRQAPG<br>KQRELVATSTHDGNTDYADSVKGRFTISRDNVKNTVYLQMNSL<br>KPEDTAVYYCNADLRTAVDLIRANYWGQGTQVTVSS |
| Exemplary anti-target (EGFR) (SEQ ID NO: 742) | QVQLQESGGGLVQPGGSLRLSCAASGSIAYIYTMDWYRQAPG<br>KQRELVATSTRDGNTDYADSVKGRFTISRDNAKDTVYLQMNSL<br>KPEDTAVYYCNADLRTAVDLIRANYWGQGTQVTVSS |
| Exemplary anti-target (EGFR) (SEQ ID NO: 743) | QVQLQESGGGLVQAGGSLTLSCAASGRYQMAWFRQAPEKER<br>EFVGTISSGDSTWYTNSVKGRFAISRDSARNTVYLQMNDLKPE<br>DTAIYYCAAALYYRDSRRAADYPYWGQGTQVTVSS |
| Exemplary anti-target (EGFR) (SEQ ID NO: 744) | QVQLQESGGRVQAGESLRLSCSTSTRTLKLYAVGWFRQAPG<br>KERDFVAGIGRSERIYYIDSVKGRFTLSRDNAKNTVFLEMNDLEP<br>EDTAVYFCAATFQTSDNVGVPTVQHEYDYWGQGTQVTVSS |
| Exemplary anti-target (EGFR) (SEQ ID NO: 745) | QVQLQESGGGLVQAGGSLRLSCAASGSIAYIYTMDWYRQAPG<br>KQRELVATSTHDGNTDYADSVKGRFTISRDNAKNTVTLQMNSL<br>KPEDTAVYYCNADLRTAVDLIRANYWGQGTQVTVSS |
| Exemplary anti-target (EGFR) (SEQ ID NO: 746) | QVQLQESGGGLVQAGGSLRLSCAASGSIAYIYTMDWYRQAPG<br>KQRELVATFTRDGNTDYADSVKGRFTISRDNAKNTVYLQMNSL<br>KPEDTAVYYCNTDLRTAVDLIRANYWGQGTQVTVSS |
| Exemplary anti-target (EGFR) (SEQ ID NO: 747) | QVQLQESGGGLVQAGGSLRLSCAASGSIAYIYTMDWYRQAPG<br>KQRELVATSTHDGNTDYADSLKGRFTISRDNAKNTVYLQMNSL<br>KPEDTAVYYCNADLRTAVDLIRANYWGQGTQVTVSS |
| Exemplary anti-target (EGFR) (SEQ ID NO: 748) | QVQLQESGGGSVQAGGSLRLSCAASGRYQMAWFRQAPEKER<br>EFVGTISSGDSTWYTNSLKGRFAISRDSARDTVYLQMNDLKPE<br>DTAVYYCAAALYYRDSRRAADYPYWGQGTQVTVSS |
| Exemplary anti-target (EGFR) (SEQ ID NO: 749) | QVQLQESGGGLVQTGGSLRLSCAVSGSIVTINAMTWYRQAPG<br>KRRELVAIITSGGETNYADSVKGRFTISRDNAKNTAHLQMNSLN<br>PEDTGVYYCNVVPPLGSWGQGTQVTVSS |
| Exemplary anti-target (EGFR) (SEQ ID NO: 750) | QVQLQESGGGLVQTGGSLRLSCAVSRSIVSIKSMTWYRQAPGK<br>RRELVALITSGGETNYSDSVKGRFTISRDNAKNTVYLQMNSLKP<br>EDTGVYYCNVVPPLGSWGQGTQVTVSS |
| Exemplary anti-target (EGFR) (SEQ ID NO: 751) | QVQLQESGGGLVETGGSLRLSCAGSGSTFRHHAMAWFRQTP<br>GKEREFVSAINDHGDRTKYLDSVRGRFTISRDNTDNMVYLQM<br>TDLRPEDTANYSCAAGPLVDYLETTPLVYTYWGHGTQVTVSS |
| Exemplary anti-target (EGFR) (SEQ ID NO: 752) | QVQLQESGGGLVQAGGSLRLSCAASGSIAYIYTMDWYRQAPG<br>KQRELVATSTHDGNTDYADSVKGRFTISRDNAKNTVYLQMNSL<br>KPEDTAVYYCNADLRTAVDLIRANYWGQGTQVTVSS |
| Exemplary anti-target (EGFR) (SEQ ID NO: 753) | QVQLQESGGGSVQAGGSLTLSCAASGSIAYIYTMDWYRQAPG<br>KQRELVATSTHDGNTDYADSVKGRFTISRDNAKNTVYLQMNSL<br>KPEDTAVYYCNADLRTAVDLIRANYWGQGTQVTVSS |
| Exemplary anti-target (EGFR) (SEQ ID NO: 754) | QVQLQESGGGLVQPGGSLRLSCTASVSIFSVNAVDWYRQSPG<br>KERELVAIMTSDGSTNYGDSVKGRFTISRDNAKNTVYLQMNNL<br>KPEDTAVYYCNTVPPRYWGQGTQVTVSS |
| Exemplary anti-target (EGFR) (SEQ ID NO: 755) | QVQLQESGGGLVQPGGSLRLSCAASGSIAYIYTMDWYRQAPG<br>KQRELVATSTRDGNIDYADSVKGRFTISRDSAKNTVYLQMSSLK<br>PEDTAVYYCNADLRTAVDLIRANYWGQGTQVTVSS |
| Exemplary anti-target (EGFR) (SEQ ID NO: 756) | QVQLQESGGGLVQAGGSLTLSCAASGRYQLAWFRQAPEKVRE<br>FVGTISSGDSTWYTNSVKGRFAISRDSARNTVYLQMNDLKPED<br>TAVYYCAAALYYRDSRRAADYPYWGQGTQVTVSS |
| Exemplary anti-target (EGFR) (SEQ ID NO: 757) | QVQLQESGGGSVQAGGSLRLSCAASGRYHMAWFRQAPEKER<br>EFVGTISSGDSTWYTNSVKGRFAISRDSARNTAYLQMNDLKPE<br>DTAVYYCAAALYYGDSRRAADYPYWGQGTQVTVSS |

SEQUENCE TABLE

| DESCRIPTION | SEQUENCE |
| --- | --- |
| Exemplary anti-target (EGFR) (SEQ ID NO: 758) | QVQLQESGGGSVQAGGSLRLSCAASGSIAYIYTMDWYRQAPG KQRELVATSTHDGNTDYTDSVKGRFTISRDNAKNTVYLQMNSL KPEDTAVYYCNADLRTAVDLIRANYWGQGTQVTVSS |
| Exemplary anti-target (EGFR) (SEQ ID NO: 759) | QVQLQESGGGLVQAGGSLRLSCAASGSIAYIYTMDWYRQTPG KQRELVATSTRDANTDYAGSVKGRFTISRDNAKDTVYLQMNSL KPEDTAVYYCHADLRTAVDLIRANYWGQGTQVTVSS |
| Exemplary anti-target (EGFR) (SEQ ID NO: 760) | QVQLQESGGGLVQAGGSLRLSCAASGRYNMAWFRQAPEKER EFVGTITSADSTWYTNSVKGRFAITQDSARNTVYLQMNDLKPE DTAVYYCAAALYYGDSRRAADYPYWGQGTQVTVSS |
| Exemplary anti-target (EGFR) (SEQ ID NO: 761) | QVQLQESGGGLVQPGGSLRLSCAASGRYQMAWFRQAPEKER EFVGTISSGDSTWYTNSVKGRFAISRDSARTTVYLQMNDLKPE DTAVYYCAAALYYRDSWRAADYPYWGQGTQVTVSS |
| Exemplary anti-target (EGFR) (SEQ ID NO: 762) | QVQLQESGGGLVQPGESLRLSCAATGRYHLAWFRQAPEKERE FVGTITSADSTWYTNSVKGRFAITRDSARNTVYLQMNDLKPED TAVYYCAAALYYGDSRRAADYPYWGQGTQVTVSS |
| Exemplary anti-target (EGFR) (SEQ ID NO: 763) | QVQLQESGGGLVQAGGSLKLSCADSGRSFSNYIMGWFRQAP GKEREFVAGLGWSPGNTYYADSVKGRFTISRDNAKNMVYLQ MNSLNPEDTAVYYCAARRGDVIYTTPWNYVYWGQGTQVTVS S |
| Exemplary anti-target (EGFR) (SEQ ID NO: 764) | QVQLQESGGGLVQAGGSLRLSCAASGSIAYIYTMDWYRQAPG KQRELVATSTHDGNTDYADSVKGRFTISRDNAKNTVYLQMNSL KPEDTAVYYCNADLRTPVDLIRANYWGQGTQVTVSS |
| Exemplary anti-target (EGFR) (SEQ ID NO: 765) | QVQLQESGGGSVQAGGSLRLSCAAPGRYQMAWFRQAPEKER EFVGTISSGDSTWYTNSVKGRFAISRDSARNTVYLQMNDLKSE DTAVYYCAAALYYRDSRRAIDYPYWGQGTQVTVSS |
| Exemplary anti-target (EGFR) (SEQ ID NO: 766) | QVQLQESGGGSVQAGGSLRLSCAASGLTFSSYAMAWFRQAP GKQRELVARITSGGTTDYADSVKGRFTISRDNAKNTMYLQMN SLKPEDTAVYYCAADLTYRNLLLKLPHYWGQGTQVTVSS |
| Exemplary anti-target (EGFR) (SEQ ID NO: 767) | QVQLQESGGGLVQAGGSLRLSCAASGNIAYIYTMDWYRQAPG KQRELVATSTHDGSTDYADSVKGRFTISRDNAKNTVYLQMNSL KPEDTAVYYCNADLRTPVDLIRANYWGQGTQVTVSS |
| Exemplary anti-target (EGFR) (SEQ ID NO: 768) | QVQLQESGGGLVQPGGSLRLSCAASGSIAYIYTMDWYRQAPG KQRELVATSTWDGNTDYADSVKGRFTISRDNAKNTVYLQMNS LKPEDTAVYYCNADLRTAVDLIRANYWGQGTQVTVSS |
| Exemplary anti-target (EGFR) (SEQ ID NO: 769) | QVQLQESGGGLVQAGGSLRLSCAASGSIAYIYTMDWYRQAPG KQRELVATSTHDGNTDYADSVKGRFTISRDNAKNTVYLQMSSL KPDDTAVYYCNADLRTAVDLIRANYWGQGTQVTVSS |
| Exemplary anti-target (EGFR) (SEQ ID NO: 770) | QVQLQESGGGLVQAGESLSLSCAASGNDFVITDMHWYRQAP GKQREWVATITRFATTNYADSVKGRFTISRDNAKNTWYLQMN SLKPDDTAVYYCKAIGLRGVPDVNRQFEVWGQGTQVTVSS |
| Exemplary anti-target (EGFR) (SEQ ID NO: 771) | QVQLQESGGGLVQAGGSLRLSCAASGAIAYIYGMGWYRQAP GNQRELVAAISSGGSTDYADSVKGRFTISRDNAKNTVYLQMSS LKPEDTAVYYCNADVRTSRNLVRSDYWGQGTQVTVSS |
| Exemplary anti-target (EGFR) (SEQ ID NO: 772) | QVQLQESGGGLVQAGGSLRLSCAASGRYHTAWFRQAPEKERE FVGTISSGDSTWYTNSVKGRFAISRDSARNTVYLQMNDLKPED TAVYYCAAALYYGDSRRAGDYPYWGQGTQVTVSS |
| Exemplary anti-target (EGFR) (SEQ ID NO: 773) | QVQLQESGGGLVQAGGSLRLSCAASGNIAYIYTMNWYRQAPG KQRELVATSTHAGNTDYADSVKGRFTISRDNAKNTVYLQMNSL KPEDTAVYYCNVDLRTAVDLIRANYWGQGTQVTVSS |
| Exemplary anti-target (EGFR) (SEQ ID NO: 774) | QVQLQESGGGLVQPGGSLRLSCAASGNIAYIYTMGWYRQAPG KQRELVATSTHDGNSDYADSVKGRFTISRDNAKNTVYLQMNTL KPDDTAVYYCNADLRTPVDRIRGNFWGQGTQVTVSS |
| Exemplary anti-target (EGFR) (SEQ ID NO: 775) | EVQLLESGGGLVQPGGSLTLCAASGSIAYIYTMDWYRQAPGK QRELVATSTRDGNVDYADSVKGRFTISRDNSKNTLYLQMNSLR AEDTAVYYCNADLRTAVDLIRANYWGLGTQVTVSS |

SEQUENCE TABLE

| DESCRIPTION | SEQUENCE |
|---|---|
| Exemplary anti-target (EGFR) (SEQ ID NO: 776) | EVQLLESGGGLVQPGGSLTLSCAASGRTDSWYVMGWFRQAP GKDREFVAGVSWSYGNTYYADSVKGRFTISRDNSKNTLYLQM NSLRAEDTAVYYCAARVSREVIPTRWDLYNYWGLGTQVTVSS |
| Exemplary anti-target (EGFR) (SEQ ID NO: 777) | EVQLLESGGGLVQPGGSLTLSCAASARTLRLYAVGWFRQAPGK EREFVAGIGRSERTYYTDSVKGRFTISRDNSKNTLYLQMNSLRA EDTAVYYCALTFQTTDMVDVPTTQHEYDYWGLGTQVTVSS |
| Exemplary anti-target (EGFR) (SEQ ID NO: 778) | EVQLLESGGGLVQPGGSLTLSCAASGSIVTINAMTWYRQAPGK RRELVAIITSGGETNYADSVKGRFTISRDNSKNTLYLQMNSLRAE DTAVYYCNVVPPLGSWGLGTQVTVSS |
| Exemplary anti-target (EGFR) (SEQ ID NO: 779) | EVQLLESGGGLVQPGGSLTLSCAASGRYHMAWFRQAPGKERE FVGTISSGDSTWYTNSVKGRFTISRDNSKNTLYLQMNSLRAEDT AVYYCAAALYYGDSRRAADYPYWGLGTQVTVSS |
| Exemplary anti-target (EGFR) (SEQ ID NO: 780) | EVQLLESGGGLVQPGGSLTLSCAASGSTFRHHAMAWFRQTPG KEREFVSAINDHGDRTKYLDSVKGRFTISRDNSKNTLYLQMNSL RAEDTAVYYCAAGPLVDYLETTPLVYTYWGLGTQVTVSS |
| Exemplary anti-target (EGFR) (SEQ ID NO: 781) | EVQLLESGGGLVQPGGSLTLSCAASGRSFSNYIMGWFRQAPG KEREFVAGLGWSPGNTYYADSVKGRFTISRDNSKNTLYLQMNS LRAEDTAVYYCAARRGDVIYTTPWNYVYWGLGTQVTVSS |
| Exemplary anti-target (EGFR) (SEQ ID NO: 782) | EVQLLESGGGLVQPGGSLTLSCAASGLTFSSYAMAWFRQAPGK QRELVARITSGGTTDYADSVKGRFTISRDNSKNTLYLQMNSLRA EDTAVYYCAADLTYRNLLLKLPHYWGLGTQVTVSS |
| Exemplary anti-target (EGFR) (SEQ ID NO: 783) | EVQLLESGGGLVQPGGSLTLSCAASVSIFSVNAVDWYRQSPGK ERELVAIMTSDGSTNYDDSVKGRFTISRDNSKNTLYLQMNSLR AEDTAVYYCNTVPPRYWGLGTQVTVSS |
| Exemplary anti-target (EGFR) (SEQ ID NO: 784) | EVQLLESGGGLVQPGGSLTLSCAASGNDFVITDMHWYRQAPG KQREWVATITRFATTNYADSVKGRFTISRDNSKNTLYLQMNSL RAEDTAVYYCKAIGLRGVPDVNRQFEVWGLGTQVTVSS |
| Exemplary anti-target (EGFR) (SEQ ID NO: 785) | EVQLLESGGGLVQPGGSLTLSCAASGAIAYIYGMGWYRQAPGK QRELVAAISSGGSTDYADSVKGRFTISRDNSKNTLYLQMNSLRA EDTAVYYCNADVRTSRNLVRSDYWGLGTQVTVSS |
| Exemplary EGFR ProTriTAC containing linker sequence L001 (identified by residues in bold and italics) and masking sequence M027(identified by residues that are bold and underlined) (SEQ ID No. 786) | EVQLVESGGGLVQPGNSLRLSCAASGFTFSKFGMSWVRQ*GGG GGLDGNEEPGG*LEWVSSISGSGRDTLYADSVKGRFTISRDNAK TTLYLQMNSLRPEDTAVYYCTIGGSLSVSSQGTLVTVSS GGGGKPLGLQARVVGGGGT QTVVTQEPSLTVSPGGTVTLTCASSTGAVTSGNYPNWVQQKP GQAPRGLIGGTKFLVPGTPARFSGSLLGGKAALTLSGVQPEDEA EYYCTLWYSNRWVFGGGTKLTVLGGGSGGGGSGGGGSEVQ LVESGGGLVQPGGSLKLSCAASGFTFNKYAINWVRQAPGKGLE WVARIRSKYNNYATYYADQVKDRFTISRDDSKNTAYLQMNNL KTEDTAVYYCVRHANFGNSYISYWAYWGQGTLVTVSSGGGGS GGGSEVQLLESGGGLVQPGGSLTLSCAASGRTDSWYVMGWF RQAPGKDREFVAGVSWSYGNTYYADSVKGRFTISRDNSKNTLY LQMNSLRAEDTAVYYCAARVSREVIPTRWDLYNYWGLGTQVT VSSHHHHHH |
| Exemplary EGFR ProTriTAC containing linker sequence L040 (identified by residues in bold and italics) and masking sequence M027(identified by residues that are bold and underlined) (SEQ ID No. 787) | EVQLVESGGGLVQPGNSLRLSCAASGFTFSKFGMSWVRQG*GG GGLDGNEEPGG*LEWVSSISGSGRDTLYADSVKGRFTISRDNAK TTLYLQMNSLRPEDTAVYYCTIGGSLSVSSQGTLVTVSSGGGGP QASTGRSGGGGGGT QTVVTQEPSLTVSPGGTVTLTCASSTGAVTSGNYPNWVQQKP GQAPRGLIGGTKFLVPGTPARFSGSLLGGKAALTLSGVQPEDEA EYYCTLWYSNRWVFGGGTKLTVLGGGSGGGGSGGGGSEVQ LVESGGGLVQPGGSLKLSCAASGFTFNKYAINWVRQAPGKGLE WVARIRSKYNNYATYYADQVKDRFTISRDDSKNTAYLQMNNL KTEDTAVYYCVRHANFGNSYISYWAYWGQGTLVTVSSGGGGS GGGSEVQLLESGGGLVQPGGSLTLSCAASGRTDSWYVMGWF RQAPGKDREFVAGVSWSYGNTYYADSVKGRFTISRDNSKNTLY LQMNSLRAEDTAVYYCAARVSREVIPTRWDLYNYWGLGTQVT VSSHHHHHH |
| Exemplary EGFR ProTriTAC containing linker sequence L041 (identified by residues in bold and italics) and masking | EVQLVESGGGLVQPGNSLRLSCAASGFTFSKFGMSWVRQ*GGG GGLDGNEEPGG*LEWVSSISGSGRDTLYADSVKGRFTISRDNAK TTLYLQMNSLRPEDTAVYYCTIGGSLSVSSQGTLVTVSS GGGGPQGSTGRAAGGGGGT |

SEQUENCE TABLE

| DESCRIPTION | SEQUENCE |
| --- | --- |
| sequence M027(identified by residues that are bold and underlined) (SEQ ID No. 788) | QTVVTQEPSLTVSPGGTVTLTCASSTGAVTSGNYPNWVQQKP GQAPRGLIGGTKFLVPGTPARFSGSLLGGKAALTLSGVQPEDEA EYYCTLWYSNRWVFGGGTKLTVLGGGGSGGGGSGGGGSEVQ LVESGGGLVQPGGSLKLSCAASGFTFNKYAINWVRQAPGKGLE WVARIRSKYNNYATYYADQVKDRFTISRDDSKNTAYLQMNNL KTEDTAVYYCVRHANFGNSYISYWAYWGQGTLVTVSS GGGGSGGGSEVQLLESGGGLVQPGGSLTLSCAASGRTDSWYV MGWFRQAPGKDREFVAGVSWSYGNTYYADSVKGRFTISRDN SKNTLYLQMNSLRAEDTAVYYCAARVSREVIPTRWDLYNYWGL GTQVTVSSHHHHHH |
| Exemplary EGFR ProTriTAC containing linker sequence L042 (identified by residues in bold and italics) and masking sequence M027(identified by residues that are bold and underlined) (SEQ ID No. 789) | EVQLVESGGGLVQPGNSLRLSCAASGFTFSKFGMSWVRQ*GGG GGLDGNEEPGG*LEWVSSISGSRDTLYADSVKGRFTISRDNAK TTLYLQMNSLRPEDTAVYYCTIGGSLSVSSQGTLVTVSSGGGG*P PASSGRAGG*GGGT QTVVTQEPSLTVSPGGTVTLTCASSTGAVTSGNYPNWVQQKP GQAPRGLIGGTKFLVPGTPARFSGSLLGGKAALTLSGVQPEDEA EYYCTLWYSNRWVFGGGTKLTVLGGGGSGGGGSGGGGSEVQ LVESGGGLVQPGGSLKLSCAASGFTFNKYAINWVRQAPGKGLE WVARIRSKYNNYATYYADQVKDRFTISRDDSKNTAYLQMNNL KTEDTAVYYCVRHANFGNSYISYWAYWGQGTLVTVSS GGGGSGGGSEVQLLESGGGLVQPGGSLTLSCAASGRTDSWYV MGWFRQAPGKDREFVAGVSWSYGNTYYADSVKGRFTISRDN SKNTLYLQMNSLRAEDTAVYYCAARVSREVIPTRWDLYNYWGL GTQVTVSSHHHHHH |
| Exemplary EGFR ProTriTAC containing linker sequence L045 (identified by residues in bold and italics) and masking sequence M027(identified by residues that are bold and underlined) (SEQ ID No. 790) | EVQLVESGGGLVQPGNSLRLSCAASGFTFSKFGMSWVRQ*GGG GGLDGNEEPGG*LEWVSSISGSRDTLYADSVKGRFTISRDNAK TTLYLQMNSLRPEDTAVYYCTIGGSLSVSSQGTLVTVSSGGGG*P IPVQGRAH*GGGGTQTVVTQEPSLTVSPGGTVTLTCASSTGAVT SGNYPNWVQQKPGQAPRGLIGGTKFLVPGTPARFSGSLLGGK AALTLSGVQPEDEAEYYCTLWYSNRWVFGGGTKLTVLGGGGS GGGGSGGGGSEVQLVESGGGLVQPGGSLKLSCAASGFTFNKY AINWVRQAPGKGLEWVARIRSKYNNYATYYADQVKDRFTISR DDSKNTAYLQMNNLKTEDTAVYYCVRHANFGNSYISYWAYW GQGTLVTVSSGGGGSGGGS EVQLLESGGGLVQPGGSLTLSCAASGRTDSWYVMGWFRQAP GKDREFVAGVSWSYGNTYYADSVKGRFTISRDNSKNTLYLQM NSLRAEDTAVYYCAARVSREVIPTRWDLYNYWGLGTQVTVSSH HHHHH |
| Exemplary EGFR ProTriTAC containing a non cleavable linker sequence(identified by residues in bold and italics) and masking sequence M027(identified by residues that are bold and underlined) (SEQ ID No. 791) | EVQLVESGGGLVQPGNSLRLSCAASGFTFSKFGMSWVRQGGG GGLDGNEEPGGLEWVSSISGSGRDTLYADSVKGRFTISRDNAK TTLYLQMNSLRPEDTAVYYCTIGGSLSVSSQGTLVTVSSGGGGG*S GGGGSGGVV*GGGGTQTVVTQEPSLTVSPGGTVTLTCASSTGA VTSGNYPNWVQQKPGQAPRGLIGGTKFLVPGTPARFSGSLLG GKAALTLSGVQPEDEAEYYCTLWYSNRWVFGGGTKLTVLGGG GSGGGGSGGGGSEVQLVESGGGLVQPGGSLKLSCAASGFTFN KYAINWVRQAPGKGLEWVARIRSKYNNYATYYADQVKDRFTIS RDDSKNTAYLQMNNLKTEDTAVYYCVRHANFGNSYISYWAY WGQGTLVTVSS GGGGSGGGSEVQLLESGGGLVQPGGSLTLSCAASGRTDSWYV MGWFRQAPGKDREFVAGVSWSYGNTYYADSVKGRFTISRDN SKNTLYLQMNSLRAEDTAVYYCAARVSREVIPTRWDLYNYWGL GTQVTVSSHHHHHH |
| Exemplary GFP TriTAC Sequence (SEQ ID No. 792) | QVQLVESGGALVQPGGSLRLSCAASGFPVNRYSMRWYRQAP GKEREWVAGMSSAGDRSSYEDSVKGRFTISRDDARNTVYLQM NSLKPEDTAVYYCNVNVGFEYWGQGTQVTVSSGGGGSGGGS EVQLVESGGGLVQPGNSLRLSCAASGFTFSKFGMSWVRQAPG KGLEWVSSISGSGRDTLYADSVKGRFTISRDNAKTTLYLQMNSL RPEDTAVYYCTIGGSLSVSSQGTLVTVSSGGGGSGGGGSEVQLVE SGGGLVQPGGSLKLSCAASGFTFNKYAINWVRQAPGKGLEWV ARIRSKYNNYATYYADQVKDRFTISRDDSKNTAYLQMNNLKTE DTAVYYCVRHANFGNSYISYWAYWGQGTLVTVSSGGGGSGG GGSGGGGSQTVVTQEPSLTVSPGGTVTLTCASSTGAVTSGNYP NWVQQKPGQAPRGLIGGTKFLVPGTPARFSGSLLGGKAALTLS GVQPEDEAEYYCTLWYSNRWVFGGGTKLTVLHHHHHH |
| Exemplary EGFR TriTAC Sequence (SEQ ID No. 793) | EVQLLESGGGLVQPGGSLTLSCAASGRTDSWYVMGWFRQAP GKDREFVAGVSWSYGNTYYADSVKGRFTISRDNSKNTLYLQM NSLRAEDTAVYYCAARVSREVIPTRWDLYNYWGLGTQVTVSSG GGGSGGGSEVQLVESGGGLVQPGNSLRLSCAASGFTFSKFGM SWVRQAPGKGLEWVSSISGSGRDTLYADSVKGRFTISRDNAKT TLYLQMNSLRPEDTAVYYCTIGGSLSVSSQGTLVTVSSGGGGSG |

SEQUENCE TABLE

| DESCRIPTION | SEQUENCE |
| --- | --- |
| | GGSEVQLVESGGGLVQPGGSLKLSCAASGFTFNKYAINWVRQ APGKGLEWVARIRSKYNNYATYYADQVKDRFTISRDDSKNTAY LQMNNLKTEDTAVYYCVRHANFGNSYISYWAYWGQGTLVTV SSGGGGSGGGGSGGGGSQTVVTQEPSLTVSPGGTVTLTCASST GAVTSGNYPNWVQQKPGQAPRGLIGGTKFLVPGTPARFSGSL LGGKAALTLSGVQPEDEAEYYCTLWYSNRWVFGGGTKLTVLH HHHHH |
| Exemplary anti-CD3 scFv (SEQ ID NO: 794) | QTVVTQEPSLTVSPGGTVTLTCASSTGAVTSGNYPNWVQQKP GQAPRGLIGGTKFLVPGTPARFSGSLLGGKAALTLSGVQPEDEA EYYCTLWYSNRWVFGGGTKLTVLGGGGSGGGGSGGGGSEVQ LVESGGGLVQPGGSLKLSCAASGFTFNKYAINWVRQAPGKGLE WVARIRSKYNNYATYYADQVKDRFTISRDDSKNTAYLQMNNL KTEDTAVYYCVRHANFGNSYISYWAYWGQGTLVTVSS |
| Exemplary anti-target (EpCAM) (SEQ ID NO: 804) EPL90 | QVQLQESGGGLVQAGGSLRLSCAASGFIFRAASMAWYRQSPG NERELVASISSGAFTNYADSVKARFTISRDNAKNTVYLQMNSLK PEDTAVYFCGATFLRSDGHHTINGQGTQVTVSS |
| Exemplary anti-target (EpCAM) (SEQ ID NO: 805) EPL118 | QVQLQESGGGLVQAGGSLRLSCAASGFIFRAASMGWFRQSPG NERELVATVSSGDFTNYADSVKGRFTISRDNAKNTVYLQMNSL KPEDTAVYFCGATFVRSDGHHTIYGQGTQVTVSS |
| Exemplary anti-target (EpCAM) (SEQ ID NO: 806) EPL138 | QVQLQESGGGLVQAGGSLRLSCAASGFIFRAASMDWYRQFPG NERESIATISSGGFTNYADSVKGRFTISRDNAKNTVYLQMNSLK PEDTAVYFCGATFLRSDGHHTINGQGTQVTVSS |
| Exemplary anti-target (EpCAM) (SEQ ID NO: 807) EPL145 | QVQLQESGGGLVQAGGSLRLSCAASGFIFRAASMGWFRQSPG NERELVATVSSGGFTNYADSVKGRFTISRDNAKNTVYLQMNSL KPEDTAVYFCGATFVRSDGHHTIYGQGTQVTVSS |
| Exemplary anti-target (EpCAM) (SEQ ID NO: 808) EPL164 | QVQLQESGGGLVQAGGSLRLSCAASGFIFRAASMDWYRQSPG TQPELVATISSTGFTNYANSVKGRFTISRDNAKNTVYLQMNSL PEDTAVYFCGATFLRSDGQHSIYGQGTQVTVSS |
| Exemplary anti-target (EpCAM) (SEQ ID NO: 809) EPL31 | QVQLQESGGGLVHTGGSLRLSCAASGDTFLRYAMGWFRQAP GKEREFVAAITWNGGNTDYAGSLKGRFTISRDNTKNTVYLQM NSLKPEDTAVYYCAADLTFGLASSHYQYDYWGQGTQVTVSS |
| Exemplary anti-target (EpCAM) (SEQ ID NO: 810) EPL55 | QVQLQESGGGLVQAGGSLRLSCAASGDTFLRYAMGWFRQAP GKEREFVAAITWNGGNTDYAGSLKGRFTISRDNTKNTVYLQM NSLKPEDTAVYYCAADLTFGLASSHYQYDYWGQGTQVTVSS |
| Exemplary anti-target (EpCAM) (SEQ ID NO: 811) EPL57 | QVQLQESGGGLVHTGGSLRLSCAFSGDTFLRYAMGWFRQAP GKEREFVAAITWNGGNTDYADSLKGRFTISRDNTKNTVYLQM NSLRPEDTAVYYCAADLTFGLASSHYQYDYWGQGTQVTVSS |
| Exemplary anti-target (EpCAM) (SEQ ID NO: 812) EPL136 | QVQLQESGGGLVQPGGSLRLSCAASGDTFLRYAMGWFRQAP GKEREFVAAITWNGGNTDYAGSLKGRFTISRDNTKNTVYLQM NSLKPEDTAVYYCAADLTFGLASSHYQYDYWGQGTQVTVSS |
| Exemplary anti-target (EpCAM) (SEQ ID NO: 813) EPL15 | QVQLQESGGGSVLAGGSLRLSCAASGFTFSSYYMSWVRQAPG KGLEWVSGIHYTGDWTNYADSVKGRFTISRDNAKNELYLEMN NLKPEDTAVYYCARGSDKGQGTQVTVSS |
| Exemplary anti-target (EpCAM) (SEQ ID NO: 814) EPL34 | QVQLQESGGGSVQAGGSLRLSCAASGFTFSSYYMSWVRQAP GKGLEWVSGIHYTGDWTNYADSVKGRFTISRDNAKNELYLEM NNLKPEDTAVYYCARGSDKGQGTQVTVSS |
| Exemplary anti-target (EpCAM) (SEQ ID NO: 815) EPL86 | QVQLQESGGGLVQPGGSLRLSCAASGFTFSDWAMSWVRQAP GKGLEWVSGIHYGDHTTHYADFVKGRFTISRDDAKNTLYLQM NSLKPEDTAVYYCARGSTKGQGTQVTVSS |
| Exemplary anti-target (EpCAM) (SEQ ID NO: 816) EPL153 | QVQLQESGGGLVQPGGSLRLSCAASGFTFSDWAMSWVRQAP GKGLEWVSSIHYGDHTTHYADFVKGRFTISRDDAKNTLYLQMN SLKPEDTAVYYCEKGTTRGQGTQVTVSS |
| Exemplary anti-target (EpCAM) (SEQ ID NO: 817) EPL20 | QVQLQESGGGLVQAGGSLKLSCAASGNVFRAATMAWYRQAP EKQREMVATIASGGTTNYADFVKGRFTISRDNAKNTVYLQMN TLKPEDTAVYYCNAGYLTSLGPKNYWGQGTQVTVSS |
| Exemplary anti-target (EpCAM) (SEQ ID NO: 818) EPL70 | QVQLQESGGGLVQPGGSLRLSCAASGNVFRAATMAWYRQAP EKXREMVATIASGGTTNYADFVKGRFTISRDNAKNTVYLQMNT LKPEDTAVYYCNAGYLTSLGPKNYWGQGTQVTVSS |

SEQUENCE TABLE

| DESCRIPTION | SEQUENCE |
| --- | --- |
| Exemplary anti-target (EpCAM) (SEQ ID NO: 819) EPL125 | QVQLQESGGGLVQAGGSLRLSCAASGNVFRAATMAWYRQVP EKQREMVATIASGGTTNYADFVKGRFTISRDNAKNTVYLQMN TLKPEDTAVYYCNALYLTSLGPKSYWGQGTQVTVSS |
| Exemplary anti-target (EpCAM) (SEQ ID NO: 820) EPL13 | QVQLQESGGGLVQPGGSLRLSCAASGFAFGNHWMYWYRQA PGRGRELVASISSGGSTNYVDSVKGRFTISRDNARNTVYLQMYS LKPEDTAVYYCGTSDNWGQGTQVTVSS |
| Exemplary anti-target (EpCAM) (SEQ ID NO: 821) EPL129 | QVQLQESGGGLVQAGGSLRLSCAASGFAFGNHWMYWYRQA PGRGRELVASISSGGSTNYVDSVKGRFTISRDNARNTVYLQMYS LRPEDTAVYYCGTSDNWGQGTQVTVSS |
| Exemplary anti-target (EpCAM) (SEQ ID NO: 822) EPL159 | QVQLQESGGGLVQAGGSLRLSCAASGFAFGNHWMYWYRQA PGRGRELVASISSGGSTNYVDSVKGRFTISRDNARNTVYLQMYS LKPEDTAVYYCGTSDNWGQGTQVTVSS |
| Exemplary anti-target (EpCAM) (SEQ ID NO: 823) EPL120 | QVQLQESGGGLVQAGGSLRLSCAASGFIFRAASISWYRQSPGN ERELVATINSGGFTNYADSVLGRFTISRDNAKNTGYLQMNSLKP EDTAVYFCAATFLRSDGQPPIWGQGTQVTVSS |
| Exemplary anti-target (EpCAM) (SEQ ID NO: 824) EPL126 | QVQLQESGGGLVQAGGSLRLSCAASGFIFRAASMGWYRQSPG NERELVATINSGGFTNYADSVKGRFTISRDNAKNTGYLQMNSL KPEDTAVYFCAATFLRSDGQPPIWGQGTQVTVSS |
| Exemplary anti-target (EpCAM) (SEQ ID NO: 825) EPL60 | QVQLQESGGGLVQAGGSLRLSCAASEYILSMYRMAWYRQAP GKVRELVADMSSGGTTNYADFVKGRFTISRDNDRNTVYLQMN RLQPEDTAAYYCNVAGRTGPPSYDAFNNWGQGTQVTVSS |
| Exemplary anti-target (EpCAM) (SEQ ID NO: 826) EPL156 | QVQLQESGGGLVQPGASLRVSCAASEYILSMYRMAWYRQAP GKVRELVADMSSGGTTNYADFVKGRFTISRDNDRNTVYLQMN RLQPEDTAAYYCNVAGRTGPPSYDAFNNWGQGTQVTVSS |
| Exemplary anti-target (EpCAM) (SEQ ID NO: 827) EPL2 | QVQLQESGGGLVQPGGSLRLSCAASESISSFIAVGWYRQAPGK ERELVAGINRSGFTYYTDSVKGRFSISRDNAKNTVLLQMTSLKP EDTAVYYCNAGGLYFSNAYTQGDYWGQGTQVTVSS |
| Exemplary anti-target (EpCAM) (SEQ ID NO: 828) EPL43 | QVQLQESGGGLVQTGGSLRLSCAASESISSFIAVGWYRQAPGK ERELVAGINRSGFTYYTDSVKGRFSISRDNAKNTVLLQMTSLKP EDTAVYYCNAGGLYFSNAYTQGDYWGQGTQVTVSS |
| Exemplary anti-target (EpCAM) (SEQ ID NO: 829) EPL10 | QVQLQESGGGLVQAGGSLRLSCAASGSVFRANVMGWYRQAP GKQHELVARIDPGGTTTYADPVKGRFTISRDNAKKTVYLQMNS LKPDDTAVYYCNAIILLSGGPKDYWGQGTQVTVSS |
| Exemplary anti-target (EpCAM) (SEQ ID NO: 830) EPL49 | QVQLQESGGGLVQAGGSLRLSCAPSGRTSSIFGMGWFRQAPG KEREFVASINWSGGSTSYADSVKGRFTISRDNAKNEMYLQMN SLKFEDTAVYVCAAAVLTNKPSWNFWGQGTQVTVSS |
| Exemplary anti-target (EpCAM) (SEQ ID NO: 831) EPL58 | QVQLQESGGGLVQAGGSLRLSCAASGPIFSDTIRTMGWYRQA AGKQRELVATIASFPSRTNYVDSVKGRFTISRDIAKNTVYLQMD SLKPEDTAVYYCNVDLASIPTKTYWGQGTQVTVSS |
| Exemplary anti-target (EpCAM) (SEQ ID NO: 832) EPL74 | QVQLQESGGGLVQAGGSLRLSCAASGSIFGINAMGWYRQAP GKQRESVAFITIGGNTNYLDSVKGRFTISRDNAKNTVYLQMNG LKPEDTAVYYCNTNPPLILTAGGLYWGQGTQVTVSS |
| Exemplary anti-target (EpCAM) (SEQ ID NO: 833) EPL78 | QVQLQESGGGLVQPGGSLRLSCATSANRFNINVMGWYRQAP GQQRELVATINIGGSTDYADSVKGRFTISRDNAKNTVYLQLSDL KPEDTAVYYCNVKLRVSGPTGPNVYWGQGTQVTVSS |
| Exemplary anti-target (EpCAM) (SEQ ID NO: 834) EPL82 | QVQLQESGGGLVQAGGSLKLSCTASGTILSTMAWYRQAPGKQ RELVATISRGGTTNYSDSVKGRFAISRDSTKNTVYLQMNSLKPE DTAVYYCNTPLTDYGMGYNWGQGTQVTVSS |
| Exemplary anti-target (EpCAM) (SEQ ID NO: 835) EPL83 | QVQLQESGGGLVQAGGSLRLSCAVSGSIFSLNTLAWYRQAPGR QRDLIARITGGGTTVYADSVKGRFTISRDNAKNTVYLQMNSLKP EDTAVYYCNLMVRHPSGSTYEYWGQGTQVTVSS |
| Exemplary anti-target (EpCAM) (SEQ ID NO: 836) EPL97 | QVQLQESGGGLVQAGGSLRLSCAASGIIFRGTTMGWFRQAPG KQRESVASISPLGTTSYSGSVEGRFTVSRDNAKNTLFLQMNSLK SEDTAVYYCNAIQVTNVGPRVYWGQGTQVTVSS |
| Exemplary anti-target (EpCAM) (SEQ ID NO: 837) EPL109 | QVQLQESGGGLVQPGGSLRLSCASSGFTLDDYTIGWFRQAPG KEREGVSCISRRDDSTYYADSVKGRFTISRDNAKNTVDLQMISL RPEDTAVYYCAATPRSYTLRCLGKFDFQGQGTQVTVSS |

| SEQUENCE TABLE | |
|---|---|
| DESCRIPTION | SEQUENCE |
| Exemplary anti-target (EpCAM) (SEQ ID NO: 838) EPL117 | QVQLQESGGGLVQAGGSLRLSCAASGNIVRMTNMAWYRQA PGKQREFVATISAGGSTTYVDSVKDRFTISRDNTKNTVYLQMN YLKPEDTAVYYCATGSILTNRGAIPGSWGHGTQVTVSS |
| Exemplary anti-target (EpCAM) (SEQ ID NO: 839) EPL127 | QVQLQESGGGLVQAGGSLRLSCAAPGFAFNDHAILWFRQAPG KEREGVSEICRDGTTYYTDSVKGRFTISSDNAKNTVYLQMNSVK TDDTAVYYCAVDRRRYYCSGNRAFSSDYYYWGQGTQVTVSS |
| Exemplary anti-target (EpCAM) (SEQ ID NO: 840) EPL152 | QVQLQESGGGLVQAGGSLRLSCVHSGSIFRASTMAWYRQAPG KQRELVAQIMSGGGTNYAGSVKGRFTISRDNANNTVYLQMNS LKPEDTAVYYCNAAQITSWGPKVYWGQGTQVTVSS |
| Exemplary anti-target (EpCAM) (SEQ ID NO: 841) EPL189 | QVQLQESGGGLVQPGGSLRLSCAASGRINSINTMGWYRQAPG NQRELVAEITRGGTTNYADSVQGRYAISRDNAKNLVYLQMNSL KPEDTDVYYCNAQTFPTFSRPTGLDYWGQGTQVTVSS |
| Exemplary anti-CD3/anti-EpCAM fusion protein(SEQ ID NO: 842) EPL10 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQAGGSLRLSCAASGSVFR ANVMGWYRQAPGKQHELVARIDPGGTTTYADPVKGRFTISRD NAKKTVYLQMNSLKPDDTAVYYCNAILLSGGPKDYWGQGTQ VTVSSHHHHHH* |
| Exemplary anti-CD3/anti-EpCAM fusion protein(SEQ ID NO: 843) EPL109 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQPGGSLRLSCASSGFTLD DYTIGWFRQAPGKEREGVSCISRDDSTYYADSVKGRFTISRDN AKNTVDLQMISLRPEDTAVYYCAATPRSYTLRCLGKFDFQGQG TQVTVSSHHHHHH* |
| Exemplary anti-CD3/anti-EpCAM fusion protein(SEQ ID NO: 844) EPL117 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQAGGSLRLSCAASGNIVR MTNMAWYRQAPGKQREFVATISAGGSTTYVDSVKDRFTISRD NTKNTVYLQMNYLKPEDTAVYYCATGSILTNRGAIPGSWGHGT QVTVSSHHHHHH* |
| Exemplary anti-CD3/anti-EpCAM fusion protein(SEQ ID NO: 845) EPL120 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQAGGSLRLSCAASGFIFR AASISWYRQSPGNERELVATINSGGFTNYADSVLGRFTISRDNA KNTGYLQMNSLKPEDTAVYFCAATFLRSDGQPPIWGQGTQVT VSSHHHHHH* |
| Exemplary anti-CD3/anti-EpCAM fusion protein(SEQ ID NO: 846) EPL125 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQAGGSLRLSCAASGNVFR AATMAWYRQVPEKQREMVATIASGGTTNYADFVKGRFTISRD NAKNTVYLQMNTLKPEDTAVYYCNALYLTSLGPKSYWGQGTQ VTVSSHHHHHH* |
| Exemplary anti-CD3/anti-EpCAM fusion protein(SEQ ID NO: 847) EPL127 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG |

SEQUENCE TABLE

| DESCRIPTION | SEQUENCE |
|---|---|
| | GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQAGGSLRLSCAAPGFAFN<br>DHAILWFRQAPGKEREGVSEICRDGTTYYTDSVKGRFTISSDNA<br>KNTVYLQMNSVKTDDTAVYYCAVDRRRYYCSGNRAFSSDYYY<br>WGQGTQVTVSSHHHHHH* |
| Exemplary anti-CD3/anti-EpCAM fusion protein(SEQ ID NO: 848) EPL13 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQPGGSLRLSCAASGFAFG<br>NHWMYWYRQAPGRGRELVASISSGGSTNYVDSVKGRFTISRD<br>NARNTVYLQMYSLKPEDTAVYYCGTSDNWGQGTQVTVSSHH<br>HHHH* |
| Exemplary anti-CD3/anti-EpCAM fusion protein(SEQ ID NO: 849) EPL136 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQPGGSLRLSCAASGDTFL<br>RYAMGWFRQAPGKEREFVAAITWNGGNTDYAGSLKGRFTISR<br>DNTKNTVYLQMNSLKPEDTAVYYCAADLTFGLASSHYQYDYW<br>GQGTQVTVSSHHHHHH* |
| Exemplary anti-CD3/anti-EpCAM fusion protein(SEQ ID NO: 850) EPL138 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQAGGSLRLSCAASGFIFR<br>AASMDWYRQFPGNERESIATISSGGFTNYADSVKGRFTISRDN<br>AKNTVYLQMNSLKPEDTAVYFCGATFLRSDGHHTINGQGTQV<br>TVSSHHHHHH* |
| Exemplary anti-CD3/anti-EpCAM fusion protein(SEQ ID NO: 851) EPL145 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQAGGSLRLSCAASGFIFR<br>AASMGWFRQSPGNERELVATSSGGFTNYADSVKGRFTISRD<br>NAKNTVYLQMNSLKPEDTAVYFCGATFVRSDGHHTIYGQGTQ<br>VTVSSHHHHHH* |
| Exemplary anti-CD3/anti-EpCAM fusion protein(SEQ ID NO: 852) EPL152 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQAGGSLRLSCVHSGSIFR<br>ASTMAWYRQAPGKQRELVAQIMSGGGTNYAGSVKGRFTISR<br>DNANNTVYLQMNSLKPEDTAVYYCNAAQITSWGPKVYWGQ<br>GTQVTVSSHHHHHH* |
| Exemplary anti-CD3/anti-EpCAM fusion protein(SEQ ID NO: 853) EPL153 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQPGGSLRLSCAASGFTFS<br>DWAMSWVRQAPGKGLEWVSSIHYGDHTTHYADFVKGRFTIS<br>RDDAKNTLYLQMNSLKPEDTAVYYCEKGTTRGQGTQVTVSSH<br>HHHHH* |

SEQUENCE TABLE

| DESCRIPTION | SEQUENCE |
|---|---|
| Exemplary anti-CD3/anti-EpCAM fusion protein(SEQ ID NO: 854) EPL156 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQPGASLRVSCAASEYILS MYRMAWYRQAPGKVRELVADMSSGGTTNYADFVKGRFTISR DNDRNTVYLQMNRLQPEDTAAYYCNVAGRTGPPSYDAFNN WGQGTQVTVSSHHHHHH* |
| Exemplary anti-CD3/anti-EpCAM fusion protein(SEQ ID NO: 855) EPL164 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQAGGSLRLSCAASGFIFR AASMDWYRQSPGTQPELVATISSTGFTNYANSVKGRFTISRDN AKNTVYLQMNSLKPEDTAVYFCGATFLRSDGQHSIYGQGTQV TVSSHHHHHH* |
| Exemplary anti-CD3/anti-EpCAM fusion protein(SEQ ID NO: 856) EPL189 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQPGGSLRLSCAASGRINSI NTMGWYRQAPGNQRELVAEITRGGTTNYADSVQGRYAISRD NAKNLVYLQMNSLKPEDTDVYYCNAQTFPTFSRPTGLDYWGQ GTQVTVSSHHHHHH* |
| Exemplary anti-CD3/anti-EpCAM fusion protein(SEQ ID NO: 857) EPL2 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQPGGSLRLSCAASESISSFI AVGWYRQAPGKERELVAGINRSGFTYYTDSVKGRFSISRDNAK NTVLLQMTSLKPEDTAVYYCNAGGLYFSNAYTQGDYWGQGT QVTVSSHHHHHH* |
| Exemplary anti-CD3/anti-EpCAM fusion protein(SEQ ID NO: 858) EPL20 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQAGGSLKLSCAASGNVFR AATMAWYRQAPEKQREMVATIASGGTTNYADFVKGRFTISRD NAKNTVYLQMNTLKPEDTAVYYCNAGYLTSLGPKNYWGQGT QVTVSSHHHHHH* |
| Exemplary anti-CD3/anti-EpCAM fusion protein(SEQ ID NO: 859) EPL34 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGSVQAGGSLRLSCAASGFTFS SYYMSWVRQAPGKGLEWVSGIHYTGDWTNYADSVKGRFTISR DNAKNELYLEMNNLKPEDTAVYYCARGSDKGQGTQVTVSSHH HHHH* |
| Exemplary anti-CD3/anti-EpCAM fusion protein(SEQ ID NO: 860) EPL49 | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSQVQLQESGGGLVQAGGSLRLSCAPSGRTSSI FGMGWFRQAPGKEREFVASINWSGGSTSYADSVKGRFTISRD |

SEQUENCE TABLE

| DESCRIPTION | SEQUENCE |
|---|---|
| | NAKNEMYLQMNSLKFEDTAVYVCAAAVLTNKPSWNFWGQG<br>TQVTVSSHHHHHH* |
| Exemplary anti-CD3/anti-EpCAM fusion protein(SEQ ID NO: 861) EPL58 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQAGGSLRLSCAASGPIFS<br>DTIRTMGWYRQAAGKQRELVATIASFPSRTNYVDSVKGRFTIS<br>RDIAKNTVYLQMDSLKPEDTAVYYCNVDLASIPTKTYWGQGTQ<br>VTVSSHHHHHH* |
| Exemplary anti-CD3/anti-EpCAM fusion protein(SEQ ID NO: 862) EPL74 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQAGGSLRLSCAASGSIFGI<br>NAMGWYRQAPGKQRESVAFITIGGNTNYLDSVKGRFTISRDN<br>AKNTVYLQMNGLKPEDTAVYYCNTNPPLILTAGGLYWGQGTQ<br>VTVSSHHHHHH* |
| Exemplary anti-CD3/anti-EpCAM fusion protein(SEQ ID NO: 863) EPL78 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQPGGSLRLSCATSANRFN<br>INVMGWYRQAPGQQRELVATINIGGSTDYADSVKGRFTISRD<br>NAKNTVYLQLSDLKPEDTAVYYCNVKLRVSGPTGPNVYWGQG<br>TQVTVSSHHHHHH* |
| Exemplary anti-CD3/anti-EpCAM fusion protein(SEQ ID NO: 864) EPL82 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQAGGSLKLSCTASGTILST<br>MAWYRQAPGKQRELVATISRGGTTNYSDSVKGRFAISRDSTKN<br>TVYLQMNSLKPEDTAVYYCNTPLTDYGMGYNWGQGTQVTVS<br>SHHHHHH* |
| Exemplary anti-CD3/anti-EpCAM fusion protein(SEQ ID NO: 865) EPL83 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQAGGSLRLSCAVSGSIFSL<br>NTLAWYRQAPGRQRDLIARITGGGTTVYADSVKGRFTISRDNA<br>KNTVYLQMNSLKPEDTAVYYCNLMVRHPSGSTYEYWGQGTQ<br>VTVSSHHHHHH* |
| Exemplary anti-CD3/anti-EpCAM fusion protein(SEQ ID NO: 866) EPL86 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQPGGSLRLSCAASGFTFS<br>DWAMSWVRQAPGKGLEWVSGIHYGDHTTHYADFVKGRFTIS<br>RDDAKNTLYLQMNSLKPEDTAVYYCARGSTKGQGTQVTVSSH<br>HHHHH* |
| Exemplary anti-CD3/anti-EpCAM fusion protein(SEQ ID NO: 867) EPL90 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT |

SEQUENCE TABLE

| DESCRIPTION | SEQUENCE |
|---|---|
| | VSSGGGGSGGGSQVQLQESGGGLVQAGGSLRLSCAASGFIFR<br>AASMAWYRQSPGNERELVASISSGAFTNYADSVKARFTISRDN<br>AKNTVYLQMNSLKPEDTAVYFCGATFLRSDGHHTINGQGTQV<br>TVSSHHHHHH* |
| Exemplary anti-CD3/anti-EpCAM fusion protein(SEQ ID NO: 868) EPL97 | VVGGGGTQTVVTQEPSLTVSPGGTVTLTCASSTGAVTSGNYPN<br>WVQQKPGQAPRGLIGGTKFLVPGTPARFSGSLLGGKAALTLSG<br>VQPEDEAEYYCTLWYSNRWVFGGGTKLTVLGGGGSGGGGSG<br>GGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGSQVQLQESGGGLVQAGGSLRLSCAASGIIFRG<br>TTMGWFRQAPGKQRESVASISPLGTTSYSGSVEGRFTVSRDNA<br>KNTLFLQMNSLKSEDTAVYYCNAIQVTNVGPRVYWGQGTQVT<br>VSSHHHHHH* |
| Exemplary anti-EpCAM/anti-EpCAM fusion protein(SEQ ID NO: 869) EPL10 | GGGSQVQLQESGGGLVQAGGSLRLSCAASGSVFRANVMGWY<br>RQAPGKQHELVARIDPGGTTTYADPVKGRFTISRDNAKKTVYL<br>QMNSLKPDDTAVYYCNAIILLSGGPKDYWGQGTQVTVSSGGG<br>GSGGGGSEVQLVESGGGLVQPGGSLKLSCAASGFTFNKYAINW<br>VRQAPGKGLEWVARIRSKYNNYATYYADQVKDRFTISRDDSKN<br>TAYLQMNNLKTEDTAVYYCVRHANFGNSYISYWAYWGQGTL<br>VTVSSGGGGSGGGGSGGGGSQTVVTQEPSLTVSPGGTVTLTC<br>ASSTGAVTSGNYPNWVQQKPGQAPRGLIGGTKFLVPGTPARF<br>SGSLLGGKAALTLSGVQPEDEAEYYCTLWYSNRWVFGGGTKLT<br>VLHHHHHH* |
| Exemplary anti-EpCAM/anti-EpCAM fusion protein(SEQ ID NO: 870) EPL109 | GGGSQVQLQESGGGLVQPGGSLRLSCASSGFTLDDYTIGWFR<br>QAPGKEREGVSCISRRDDSTYYADSVKGRFTISRDNAKNTVDLQ<br>MISLRPEDTAVYYCAATPRSYTLRCLGKFDFQGQGTQVTVSSG<br>GGGSGGGSEVQLVESGGGLVQPGGSLKLSCAASGFTFNKYAIN<br>WVRQAPGKGLEWVARIRSKYNNYATYYADQVKDRFTISRDDS<br>KNTAYLQMNNLKTEDTAVYYCVRHANFGNSYISYWAYWGQG<br>TLVTVSSGGGGGGGSGGGGSQTVVTQEPSLTVSPGGTVTL<br>TCASSTGAVTSGNYPNWVQQKPGQAPRGLIGGTKFLVPGTPA<br>RFSGSLLGGKAALTLSGVQPEDEAEYYCTLWYSNRWVFGGGTK<br>LTVLHHHHHH* |
| Exemplary anti-EpCAM/anti-EpCAM fusion protein(SEQ ID NO: 871) EPL117 | GGGSQVQLQESGGGLVQAGGSLRLSCAASGNIVRMTNMAW<br>YRQAPGKQREFVATISAGGSTTYVDSVKDRFTISRDNTKNTVYL<br>QMNYLKPEDTAVYYCATGSILTNRGAIPGSWGHGTQVTVSSG<br>GGGSGGGSEVQLVESGGGLVQPGGSLKLSCAASGFTFNKYAIN<br>WVRQAPGKGLEWVARIRSKYNNYATYYADQVKDRFTISRDDS<br>KNTAYLQMNNLKTEDTAVYYCVRHANFGNSYISYWAYWGQG<br>TLVTVSSGGGGSGGGGSGGGGSQTVVTQEPSLTVSPGGTVTL<br>TCASSTGAVTSGNYPNWVQQKPGQAPRGLIGGTKFLVPGTPA<br>RFSGSLLGGKAALTLSGVQPEDEAEYYCTLWYSNRWVFGGGTK<br>LTVLHHHHHH* |
| Exemplary anti-EpCAM/anti-EpCAM fusion protein(SEQ ID NO: 872) EPL120 | GGGSQVQLQESGGGLVQAGGSLRLSCAASGFIFRAASISWYRQ<br>SPGNERELVATINSGGFTNYADSVLGRFTISRDNAKNTVYLQM<br>NSLKPEDTAVYFCAATFLRSDGQPPIWGQGTQVTVSSGGGGS<br>GGGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGGSGGGGSQTVVTQEPSLTVSPGGTVTLTCAS<br>STGAVTSGNYPNWVQQKPGQAPRGLIGGTKFLVPGTPARFSG<br>SLLGGKAALTLSGVQPEDEAEYYCTLWYSNRWVFGGGTKLTVL<br>HHHHHH* |
| Exemplary anti-EpCAM/anti-EpCAM fusion protein(SEQ ID NO: 873) EPL125 | GGGSQVQLQESGGGLVQAGGSLRLSCAASGNVFRAATMAWY<br>RQVPEKQREMVATIASGGTTNYADFVKGRFTISRDNAKNTVYL<br>QMNTLKPEDTAVYYCNALYLTSLGPKSYWGQGTQVTVSSGGG<br>GSGGGGSEVQLVESGGGLVQPGGSLKLSCAASGFTFNKYAINW<br>VRQAPGKGLEWVARIRSKYNNYATYYADQVKDRFTISRDDSKN<br>TAYLQMNNLKTEDTAVYYCVRHANFGNSYISYWAYWGQGTL<br>VTVSSGGGGSGGGGSGGGGSQTVVTQEPSLTVSPGGTVTLTC<br>ASSTGAVTSGNYPNWVQQKPGQAPRGLIGGTKFLVPGTPARF<br>SGSLLGGKAALTLSGVQPEDEAEYYCTLWYSNRWVFGGGTKLT<br>VLHHHHHH* |
| Exemplary anti-EpCAM/anti-EpCAM fusion protein(SEQ ID NO: 874) EPL127 | GGGSQVQLQESGGGLVQAGGSLRLSCAAPGFAFNDHAILWFR<br>QAPGKEREGVSEICRDGTTYYTDSVKGRFTISSDNAKNTVYLQ<br>MNSVKTDDTAVYYCAVDRRRYYCSGNRAFSSDYYWGQGTQ<br>VTVSSGGGGSGGGSEVQLVESGGGLVQPGGSLKLSCAASGFTF |

SEQUENCE TABLE

| DESCRIPTION | SEQUENCE |
|---|---|
| | NKYAINWVRQAPGKGLEWVARIRSKYNNYATYYADQVKDRFT<br>ISRDDSKNTAYLQMNNLKTEDTAVYYCVRHANFGNSYISYWAY<br>WGQGTLVTVSSGGGGSGGGGSGGGGSQTVVTQEPSLTVSPG<br>GTVTLTCASSTGAVTSGNYPNWVQQKPGQAPRGLIGGTKFLV<br>PGTPARFSGSLLGGKAALTLSGVQPEDEAEYYCTLWYSNRWVF<br>GGGTKLTVLHHHHHH* |
| Exemplary anti-EpCAM/anti-<br>EpCAM fusion protein(SEQ ID<br>NO: 875) EPL13 | GGGSQVQLQESGGGLVQPGGSLRLSCAASGFAFGNHWMYW<br>YRQAPGRGRELVASISSGGSTNYVDSVKGRFTISRDNARNTVYL<br>QMYSLKPEDTAVYYCGTSDNWGQGTQVTVSSGGGGSGGGSE<br>VQLVESGGGLVQPGGSLKLSCAASGFTFNKYAINWVRQAPGK<br>GLEWVARIRSKYNNYATYYADQVKDRFTISRDDSKNTAYLQM<br>NNLKTEDTAVYYCVRHANFGNSYISYWAYWGQGTLVTVSSGG<br>GGSGGGGSGGGGSQTVVTQEPSLTVSPGGTVTLTCASSTGAV<br>TSGNYPNWVQQKPGQAPRGLIGGTKFLVPGTPARFSGSLLGG<br>KAALTLSGVQPEDEAEYYCTLWYSNRWVFGGGTKLTVLHHHH<br>HH* |
| Exemplary anti-EpCAM/anti-<br>EpCAM fusion protein(SEQ ID<br>NO: 876) EPL136 | GGGSQVQLQESGGGLVQPGGSLRLSCAASGDTFLRYAMGWF<br>RQAPGKEREFVAAITWNGGNTDYAGSLKGRFTISRDNTKNTVY<br>LQMNSLKPEDTAVYYCAADLTFGLASSHYQYDYWGQGTQVTV<br>SSGGGGSGGGSEVQLVESGGGLVQPGGSLKLSCAASGFTFNKY<br>AINWVRQAPGKGLEWVARIRSKYNNYATYYADQVKDRFTISR<br>DDSKNTAYLQMNNLKTEDTAVYYCVRHANFGNSYISYWAYW<br>GQGTLVTVSSGGGGSGGGGSGGGGSQTVVTQEPSLTVSPGGT<br>VTLTCASSTGAVTSGNYPNWVQQKPGQAPRGLIGGTKFLVPG<br>TPARFSGSLLGGKAALTLSGVQPEDEAEYYCTLWYSNRWVFGG<br>GTKLTVLHHHHHH* |
| Exemplary anti-EpCAM/anti-<br>EpCAM fusion protein(SEQ ID<br>NO: 877) EPL138 | GGGSQVQLQESGGGLVQAGGSLRLSCAASGFIFRAASMDWY<br>RQFPGNERESIATISSGGFTNYADSVKGRFTISRDNAKNTVYLQ<br>MNSLKPEDTAVYFCGATFLRSDGHHTINGQGTQVTVSSGGGG<br>SGGGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGGSGGGGSQTVVTQEPSLTVSPGGTVTLTCAS<br>STGAVTSGNYPNWVQQKPGQAPRGLIGGTKFLVPGTPARFSG<br>SLLGGKAALTLSGVQPEDEAEYYCTLWYSNRWVFGGGTKLTVL<br>HHHHHH* |
| Exemplary anti-EpCAM/anti-<br>EpCAM fusion protein(SEQ ID<br>NO: 878) EPL145 | GGGSQVQLQESGGGLVQAGGSLRLSCAASGFIFRAASMGWF<br>RQSPGNERELVATVSSGGFTNYADSVKGRFTISRDNAKNTVYL<br>QMNSLKPEDTAVYFCGATFVRSDGHHTIYGQGTQVTVSSGGG<br>GSGGGGSEVQLVESGGGLVQPGGSLKLSCAASGFTFNKYAINW<br>VRQAPGKGLEWVARIRSKYNNYATYYADQVKDRFTISRDDSKN<br>TAYLQMNNLKTEDTAVYYCVRHANFGNSYISYWAYWGQGTL<br>VTVSSGGGGSGGGGSGGGGSQTVVTQEPSLTVSPGGTVTLTC<br>ASSTGAVTSGNYPNWVQQKPGQAPRGLIGGTKFLVPGTPARF<br>SGSLLGGKAALTLSGVQPEDEAEYYCTLWYSNRWVFGGGTKLT<br>VLHHHHHH* |
| Exemplary anti-EpCAM/anti-<br>EpCAM fusion protein(SEQ ID<br>NO: 879) EPL152 | GGGSQVQLQESGGGLVQAGGSLRLSCVHSGSIFRASTMAWYR<br>QAPGKQRELVAQIMSGGGTNYAGSVKGRFTISRDNANNTVYL<br>QMNSLKPEDTAVYYCNAAQITSWGPKVYWGQGTQVTVSSGG<br>GGSGGGGSEVQLVESGGGLVQPGGSLKLSCAASGFTFNKYAIN<br>WVRQAPGKGLEWVARIRSKYNNYATYYADQVKDRFTISRDDS<br>KNTAYLQMNNLKTEDTAVYYCVRHANFGNSYISYWAYWGQG<br>TLVTVSSGGGGSGGGGSGGGGSQTVVTQEPSLTVSPGGTVTL<br>TCASSTGAVTSGNYPNWVQQKPGQAPRGLIGGTKFLVPGTPA<br>RFSGSLLGGKAALTLSGVQPEDEAEYYCTLWYSNRWVFGGGTK<br>LTVLHHHHHH* |
| Exemplary anti-EpCAM/anti-<br>EpCAM fusion protein(SEQ ID<br>NO: 880) EPL153 | GGGSQVQLQESGGGLVQPGGSLRLSCAASGFTFSDWAMSWV<br>RQAPGKGLEWVSSIHYGDHTTHYADFVKGRFTISRDDAKNTLY<br>LQMNSLKPEDTAVYYCEKGTTRGQGTQVTVSSGGGGSGGGSE<br>VQLVESGGGLVQPGGSLKLSCAASGFTFNKYAINWVRQAPGK<br>GLEWVARIRSKYNNYATYYADQVKDRFTISRDDSKNTAYLQM<br>NNLKTEDTAVYYCVRHANFGNSYISYWAYWGQGTLVTVSSGG<br>GGSGGGGSGGGGSQTVVTQEPSLTVSPGGTVTLTCASSTGAV<br>TSGNYPNWVQQKPGQAPRGLIGGTKFLVPGTPARFSGSLLGG<br>KAALTLSGVQPEDEAEYYCTLWYSNRWVFGGGTKLTVLHHHH<br>HH* |
| Exemplary anti-EpCAM/anti-<br>EpCAM fusion protein(SEQ ID | GGGSQVQLQESGGGLVQPGASLRVSCAASEYILSMYRMAWY<br>RQAPGKVRELVADMSSGGTTNYADFVKGRFTISRDNDRNTVY |

| DESCRIPTION | SEQUENCE |
|---|---|
| NO: 881) EPL156 | LQMNRLQPEDTAAYYCNVAGRTGPPSYDAFNNWGQGTQVT<br>VSSGGGGSGGGSEVQLVESGGGLVQPGGSLKLSCAASGFTFNK<br>YAINWVRQAPGKGLEWVARIRSKYNNYATYYADQVKDRFTISR<br>DDSKNTAYLQMNNLKTEDTAVYYCVRHANFGNSYISYWAYW<br>GQGTLVTVSSGGGGSGGGGSGGGGSQTVVTQEPSLTVSPGGT<br>VTLTCASSTGAVTSGNYPNWVQQKPGQAPRGLIGGTKFLVPG<br>TPARFSGSLLGGKAALTLSGVQPEDEAEYYCTLWYSNRWVFGG<br>GTKLTVLHHHHHH* |
| Exemplary anti-EpCAM/anti-<br>EpCAM fusion protein(SEQ ID<br>NO: 882) EPL164 | GGGSQVQLQESGGGLVQAGGSLRLSCAASGFIFRAASMDWY<br>RQSPGTQPELVATISSTGFTNYANSVKGRFTISRDNAKNTVYLQ<br>MNSLKPEDTAVYFCGATFLRSDGQHSIYGQGTQVTVSSGGGG<br>SGGGGSEVQLVESGGGLVQPGGSLKLSCAASGFTFNKYAINWVR<br>QAPGKGLEWVARIRSKYNNYATYYADQVKDRFTISRDDSKNTA<br>YLQMNNLKTEDTAVYYCVRHANFGNSYISYWAYWGQGTLVT<br>VSSGGGGSGGGGSGGGGSQTVVTQEPSLTVSPGGTVTLTCAS<br>STGAVTSGNYPNWVQQKPGQAPRGLIGGTKFLVPGTPARFSG<br>SLLGGKAALTLSGVQPEDEAEYYCTLWYSNRWVFGGGTKLTVL<br>HHHHHH* |
| Exemplary anti-EpCAM/anti-<br>EpCAM fusion protein(SEQ ID<br>NO: 883) EPL189 | GGGSQVQLQESGGGLVQPGGSLRLSCAASGRINSINTMGWYR<br>QAPGNQRELVAEITRGGTTNYADSVQGRYAISRDNAKNLVYLQ<br>MNSLKPEDTDVYYCNAQTFPTFSRPTGLDYWGQGTQVTVSSG<br>GGGSGGGSEVQLVESGGGLVQPGGSLKLSCAASGFTFNKYAIN<br>WVRQAPGKGLEWVARIRSKYNNYATYYADQVKDRFTISRDDS<br>KNTAYLQMNNLKTEDTAVYYCVRHANFGNSYISYWAYWGQG<br>TLVTVSSGGGGSGGGGSGGGGSQTVVTQEPSLTVSPGGTVTL<br>TCASSTGAVTSGNYPNWVQQKPGQAPRGLIGGTKFLVPGTPA<br>RFSGSLLGGKAALTLSGVQPEDEAEYYCTLWYSNRWVFGGGTK<br>LTVLHHHHHH* |
| Exemplary anti-EpCAM/anti-<br>EpCAM fusion protein(SEQ ID<br>NO: 884) EPL2 | GGGSQVQLQESGGGLVQPGGSLRLSCAASESISSFIAVGWYRQ<br>APGKERELVAGINRSGFTYYTDSVKGRFSISRDNAKNTVLLQMT<br>SLKPEDTAVYYCNAGGLYFSNAYTQGDYWGQGTQVTVSSGG<br>GGSGGGSEVQLVESGGGLVQPGGSLKLSCAASGFTFNKYAIN<br>WVRQAPGKGLEWVARIRSKYNNYATYYADQVKDRFTISRDDS<br>KNTAYLQMNNLKTEDTAVYYCVRHANFGNSYISYWAYWGQG<br>TLVTVSSGGGGSGGGGSGGGGSQTVVTQEPSLTVSPGGTVTL<br>TCASSTGAVTSGNYPNWVQQKPGQAPRGLIGGTKFLVPGTPA<br>RFSGSLLGGKAALTLSGVQPEDEAEYYCTLWYSNRWVFGGGTK<br>LTVLHHHHHH* |
| Exemplary anti-EpCAM/anti-<br>EpCAM fusion protein(SEQ ID<br>NO: 885) EPL20 | GGGSQVQLQESGGGLVQAGGSLRLSCAASGNVFRAATMAWY<br>RQAPEKQREMVATIASGGTTNYADFVKGRFTISRDNAKNTVYL<br>QMNTLKPEDTAVYYCNAGYLTSLGPKNYWGQGTQVTVSSGG<br>GGSGGGSEVQLVESGGGLVQPGGSLKLSCAASGFTFNKYAIN<br>WVRQAPGKGLEWVARIRSKYNNYATYYADQVKDRFTISRDDS<br>KNTAYLQMNNLKTEDTAVYYCVRHANFGNSYISYWAYWGQG<br>TLVTVSSGGGGSGGGGSGGGGSQTVVTQEPSLTVSPGGTVTL<br>TCASSTGAVTSGNYPNWVQQKPGQAPRGLIGGTKFLVPGTPA<br>RFSGSLLGGKAALTLSGVQPEDEAEYYCTLWYSNRWVFGGGTK<br>LTVLHHHHHH* |
| Exemplary anti-EpCAM/anti-<br>EpCAM fusion protein(SEQ ID<br>NO: 886) EPL34 | GGGSQVQLQESGGGSVQAGGSLRLSCAASGFTFSSYYMSWVR<br>QAPGKGLEWVSGIHYTGDWTNYADSVKGRFTISRDNAKNELY<br>LEMNNLKPEDTAVYYCARGSDKGQGTQVTVSSGGGGSGGGS<br>EVQLVESGGGLVQPGGSLKLSCAASGFTFNKYAINWVRQAPG<br>KGLEWVARIRSKYNNYATYYADQVKDRFTISRDDSKNTAYLQM<br>NNLKTEDTAVYYCVRHANFGNSYISYWAYWGQGTLVTVSSG<br>GGSGGGGSGGGGSQTVVTQEPSLTVSPGGTVTLTCASSTGAV<br>TSGNYPNWVQQKPGQAPRGLIGGTKFLVPGTPARFSGSLLGG<br>KAALTLSGVQPEDEAEYYCTLWYSNRWVFGGGTKLTVLHHHH<br>HH* |
| Exemplary anti-EpCAM/anti-<br>EpCAM fusion protein(SEQ ID<br>NO: 887) EPL49 | GGGSQVQLQESGGGLVQAGGSLRLSCAPSGRTSSIFGMGWFR<br>QAPGKEREFVASINWSGGSTSYADSVKGRFTISRDNAKNEMYL<br>QMNSLKFEDTAVYVCAAAVLTNKPSWNFWGQGTQVTVSSG<br>GGGSGGGSEVQLVESGGGLVQPGGSLKLSCAASGFTFNKYAIN<br>WVRQAPGKGLEWVARIRSKYNNYATYYADQVKDRFTISRDDS<br>KNTAYLQMNNLKTEDTAVYYCVRHANFGNSYISYWAYWGQ<br>TLVTVSSGGGGSGGGGSGGGGSQTVVTQEPSLTVSPGGTVTL<br>TCASSTGAVTSGNYPNWVQQKPGQAPRGLIGGTKFLVPGTPA<br>RFSGSLLGGKAALTLSGVQPEDEAEYYCTLWYSNRWVFGGGTK<br>LTVLHHHHHH* |

SEQUENCE TABLE

| DESCRIPTION | SEQUENCE |
|---|---|
| Exemplary anti-EpCAM/anti-EpCAM fusion protein(SEQ ID NO: 888) EPL58 | GGGSQVQLQESGGGLVQAGGSLRLSCAASGPIFSDTIRTMGW YRQAAGKQRELVATIASFPSRTNYVDSVKGRFTISRDIAKNTVYL QMDSLKPEDTAVYYCNVDLASIPTKTYWGQGTQVTVSSGGGG SGGGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGGGGGSGGGGSQTVVTQEPSLTVSPGGTVTLTCAS STGAVTSGNYPNWVQQKPGQAPRGLIGGTKFLVPGTPARFSG SLLGGKAALTLSGVQPEDEAEYYCTLWYSNRWVFGGGTKLTVL HHHHHH* |
| Exemplary anti-EpCAM/anti-EpCAM fusion protein(SEQ ID NO: 889) EPL74 | GGGSQVQLQESGGGLVQAGGSLRLSCAASGSIFGINAMGWYR QAPGKQRESVAFITIGGNTNYLDSVKGRFTISRDNAKNTVYLQ MNGLKPEDTAVYYCNTNPPLILTAGGLYWGQGTQVTVSSGGG GSGGGGSEVQLVESGGGLVQPGGSLKLSCAASGFTFNKYAINW VRQAPGKGLEWVARIRSKYNNYATYYADQVKDRFTISRDDSKN TAYLQMNNLKTEDTAVYYCVRHANFGNSYISYWAYWGQGTL VTVSSGGGGSGGGGSGGGGSQTVVTQEPSLTVSPGGTVTLTC ASSTGAVTSGNYPNWVQQKPGQAPRGLIGGTKFLVPGTPARF SGSLLGGKAALTLSGVQPEDEAEYYCTLWYSNRWVFGGGTKLT VLHHHHHH* |
| Exemplary anti-EpCAM/anti-EpCAM fusion protein(SEQ ID NO: 890) EPL78 | GGGSQVQLQESGGGLVQPGGSLRLSCATSANRFNINVMGWY RQAPGQQRELVATINIGGSTDYADSVKGRFTISRDNAKNTVYL QLSDLKPEDTAVYYCNVKLRVSGPTGPNVYWGQGTQVTVSSG GGGSGGGSEVQLVESGGGLVQPGGSLKLSCAASGFTFNKYAIN WVRQAPGKGLEWVARIRSKYNNYATYYADQVKDRFTISRDDS KNTAYLQMNNLKTEDTAVYYCVRHANFGNSYISYWAYWGQG TLVTVSSGGGGSGGGGSGGGGSQTVVTQEPSLTVSPGGTVTL TCASSTGAVTSGNYPNWVQQKPGQAPRGLIGGTKFLVPGTPA RFSGSLLGGKAALTLSGVQPEDEAEYYCTLWYSNRWVFGGGTK LTVLHHHHHH* |
| Exemplary anti-EpCAM/anti-EpCAM fusion protein(SEQ ID NO: 891) EPL82 | GGGSQVQLQESGGGLVQAGGSLKLSCTASGTILSTMAWYRQA PGKQRELVATISRGGTTNYSDSVKGRFAISRDSTKNTVYLQMNS LKPEDTAVYYCNTPLTDYGMGYNWGQGTQVTVSSGGGGSGG GSEVQLVESGGGLVQPGGSLKLSCAASGFTFNKYAINWVRQAP GKGLEWVARIRSKYNNYATYYADQVKDRFTISRDDSKNTAYLQ MNNLKTEDTAVYYCVRHANFGNSYISYWAYWGQGTLVTVSS GGGGGGGGSGGGGSQTVVTQEPSLTVSPGGTVTLTCASSTG AVTSGNYPNWVQQKPGQAPRGLIGGTKFLVPGTPARFSGSLL GGKAALTLSGVQPEDEAEYYCTLWYSNRWVFGGGTKLTVLHH HHHH* |
| Exemplary anti-EpCAM/anti-EpCAM fusion protein(SEQ ID NO: 892) EPL83 | GGGSQVQLQESGGGLVQAGGSLRLSCAVSGSIFSLNTLAWYR QAPGRQRDLIARITGGGTTVYADSVKGRFTISRDNAKNTVYLQ MNSLKPEDTAVYYCNLMVRHPSGSTYEYWGQGTQVTVSSGG GGSGGGSEVQLVESGGGLVQPGGSLKLSCAASGFTFNKYAIN WVRQAPGKGLEWVARIRSKYNNYATYYADQVKDRFTISRDDS KNTAYLQMNNLKTEDTAVYYCVRHANFGNSYISYWAYWGQG TLVTVSSGGGGSGGGGSGGGGSQTVVTQEPSLTVSPGGTVTL TCASSTGAVTSGNYPNWVQQKPGQAPRGLIGGTKFLVPGTPA RFSGSLLGGKAALTLSGVQPEDEAEYYCTLWYSNRWVFGGGTK LTVLHHHHHH* |
| Exemplary anti-EpCAM/anti-EpCAM fusion protein(SEQ ID NO: 893) EPL86 | GGGSQVQLQESGGGLVQPGGSLRLSCAASGFTFSDWAMSWV RQAPGKGLEWVSGIHYGDHTTHYADFVKGRFTISRDDAKNTLY LQMNSLKPEDTAVYYCARGSTKGQGTQVTVSSGGGGSGGGSE VQLVESGGGLVQPGGSLKLSCAASGFTFNKYAINWVRQAPGK GLEWVARIRSKYNNYATYYADQVKDRFTISRDDSKNTAYLQM NNLKTEDTAVYYCVRHANFGNSYISYWAYWGQGTLVTVSSGG GGSGGGGSGGGGSQTVVTQEPSLTVSPGGTVTLTCASSTGAV TSGNYPNWVQQKPGQAPRGLIGGTKFLVPGTPARFSGSLLGG KAALTLSGVQPEDEAEYYCTLWYSNRWVFGGGTKLTVLHHHH HH* |
| Exemplary anti-EpCAM/anti-EpCAM fusion protein(SEQ ID NO: 894) EPL90 | GGGSQVQLQESGGGLVQAGGSLRLSCAASGFIFRAASMAWYR QSPGNERELVASISSGAFTNYADSVKARFTISRDNAKNTVYLQ MNSLKPEDTAVYFCGATFLRSDGHHTINGQGTQVTVSSGGGG SGGGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGGSGGGGSQTVVTQEPSLTVSPGGTVTLTCAS |

SEQUENCE TABLE

| DESCRIPTION | SEQUENCE |
|---|---|
|  | STGAVTSGNYPNWVQQKPGQAPRGLIGGTKFLVPGTPARFSG SLLGGKAALTLSGVQPEDEAEYYCTLWYSNRWVFGGGTKLTVL HHHHHH* |
| Exemplary anti-EpCAM/anti-EpCAM fusion protein(SEQ ID NO: 895) EPL97 | GGGSQVQLQESGGGLVQAGGSLRLSCAASGIIFRGTTMGWFR QAPGKQRESVASISPLGTTSYSGSVEGRFTVSRDNAKNTLFLQ MNSLKSEDTAVYYCNAIQVTNVGPRVYWGQGTQVTVSSGGG GSGGGSEVQLVESGGGLVQPGGSLKLSCAASGFTFNKYAINW VRQAPGKGLEWVARIRSKYNNYATYYADQVKDRFTISRDDSKN TAYLQMNNLKTEDTAVYYCVRHANFGNSYISYWAYWGQGTL VTVSSGGGGSGGGGSGGGGSQTVVTQEPSLTVSPGGTVTLTC ASSTGAVTSGNYPNWVQQKPGQAPRGLIGGTKFLVPGTPARF SGSLLGGKAALTLSGVQPEDEAEYYCTLWYSNRWVFGGGTKLT VLHHHHHH* |
| Exemplary humanized anti-EpCAM sequence (SEQ ID No. 896) | EVQLVESGGGLVQPGGSLTLSCAASGFAFGNHWMYWYRQAP GRGRELVASISSGGSTNYVDSVKGRFTISRDNAKNTLYLQMNSL RAEDTAVYYCGTSDNWGQGTLVTVSS |
| Exemplary humanized anti-EpCAM sequence (SEQ ID No. 897) | EVQLLESGGGLVQPGGSLTLSCAASGFIFRAASMDWYRQFPG NERESIATISSGGFTNYADSVKGRFTISRDNSKNTLYLQMNSLRA EDTAVYYCGATFLRSDGHHTINGQGTLVTVSS |
| Exemplary humanized anti-EpCAM sequence (SEQ ID No. 898) | EVQLLESGGGLVQPGGSLTLSCAASGFIFRAASMAWYRQSPG NERELVASISSGAFTNYADSVKARFTISRDNSKNTLYLQMNSLR AEDTAVYYCGATFLRSDGHHTINGQGTLVTVSS |
| Exemplary Humanized Anti-CD3/Anti-EpCAM sequence name H13 (SEQ ID No. 899) | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSEVQLVESGGGLVQPGGSLTLSCAASGFAFG NHWMYWYRQAPGRGRELVASISSGGSTNYVDSVKGRFTISRD NAKNTLYLQMNSLRAEDTAVYYCGTSDNWGQGTLVTVSSHH HHHH* |
| Exemplary Humanized Anti-CD3/Anti-EpCAM sequence name H138 (SEQ ID No. 900) | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSEVQLLESGGGLVQPGGSLTLSCAASGFIFRA ASMDWYRQFPGNERESIATISSGGFTNYADSVKGRFTISRDNS KNTLYLQMNSLRAEDTAVYYCGATFLRSDGHHTINGQGTLVTV SSHHHHHH* |
| Exemplary Humanized Anti-CD3/Anti-EpCAM sequence name H90 (SEQ ID No. 901) | VVGGGGTQTVVTQEPSLTVSPGGTVTLTCASSTGAVTSGNYPN WVQQKPGQAPRGLIGGTKFLVPGTPARFSGSLLGGKAALTLSG VQPEDEAEYYCTLWYSNRWVFGGGTKLTVLGGGGSGGGGSG GGGSEVQLVESGGGLVQPGGSLKLSCAASGFTFNKYAINWVR QAPGKGLEWVARIRSKYNNYATYYADQVKDRFTISRDDSKNTA YLQMNNLKTEDTAVYYCVRHANFGNSYISYWAYWGQGTLVT VSSGGGGSGGGSEVQLLESGGGLVQPGGSLTLSCAASGFIFRA ASMAWYRQSPGNERELVASISSGAFTNYADSVKARFTISRDNS KNTLYLQMNSLRAEDTAVYYCGATFLRSDGHHTINGQGTLVTV SSHHHHHH* |
| SEQ ID No. 902 | QDGNEEMGGITQ |
| SEQ ID No. 903 AB loop oligo WT | LVQPGN |
| SEQ ID No. 904 C"D loop oligo WT | DSVKGR |
| SEQ ID No. 905 EF loop oligo WT | SLRPED |
| EpCAM H90 TriTAC C2854 (SEQ ID No. 906) | EVQLVESGGGLVQPGNSLRLSCAASGFTFSKFGMSWVRQ APGKGLEWVSSISGSGRDTLYADSVKGRFTISRDNAKTT LYLQMNSLRPEDTAVYYCTIGGSLSVSSQGTLVTVSSGG GGSGGGSQTVVTQEPSLTVSPGGTVTLTCASSTGAVTSG |

SEQUENCE TABLE

| DESCRIPTION | SEQUENCE |
|---|---|
| | NYPNWVQQKPGQAPRGLIGGTKFLVPGTPARFSGSLLGG<br>KAALTLSGVQPEDEAEYYCTLWYSNRWVFGGGTKLTVLG<br>GGGSGGGGSGGGGSEVQLVESGGGLVQPGGSLKLSCAAS<br>GFTENKYAINWVRQAPGKGLEWVARIRSKYNNYATYYAD<br>QVKDRFTISRDDSKNTAYLQMNNLKTEDTAVYYCVRHAN<br>FGNSYISYWAYWGQGTLVTVSSGGGGSGGGSEVQLLESG<br>GGLVQPGGSLTLSCAASGFIFRAASMAWYRQSPGNEREL<br>VASISSGAFTNYADSVKARFTISRDNSKNTLYLQMNSLR<br>AEDTAVYYCGATFLRSDGHHTINGQGTLVTVSSHHHHHH |
| EpCAM H90 ProTriTAC<br>(L040) C2704<br>(SEQ ID No. 907) | QTVVTQEPSLTVSPGGTVTLTCASSTGAVTSGNYPNWVQ<br>QKPGQAPRGLIGGTKFLVPGTPARFSGSLLGGKAALTLS<br>GVQPEDEAEYYCTLWYSNRWVFGGGTKLTVLGGGGSGGG<br>GSGGGGSEVQLVESGGGLVQPGGSLKLSCAASGFTENKY<br>AINWVRQAPGKGLEWVARIRSKYNNYATYYADQVKDRFT<br>ISRDDSKNTAYLQMNNLKTEDTAVYYCVRHANFGNSYIS<br>YWAYWGQGTLVTVSSGGGGSGGGSEVQLLESGGGLVQPG<br>GSLTLSCAASGFIFRAASMAWYRQSPGNERELVASISSG<br>AFTNYADSVKARFTISRDNSKNTLYLQMNSLRAEDTAVY<br>YCGATFLRSDGHHTINGQGTLVTVSSHHHHHH |
| EpCAM H90 ProTriTAC<br>(NCLV) C2302<br>(SEQ ID No. 908) | EVQLVESGGGLVQPGNSLRLSCAASGFTFSKFGMSWVRQ<br>GGGGGLDGNEEPGGLEWVSSISGSGRDTLYADSVKGRFT<br>ISRDNAKTTLYLQMNSLRPEDTAVYYCTIGGSLSVSSQG<br>TLVTVSSGGGGSGGGGSGGVVGGGGTQTVVTQEPSLTVS<br>PGGTVTLTCASSTGAVTSGNYPNWVQQKPGQAPRGLIGG<br>TKFLVPGTPARFSGSLLGGKAALTLSGVQPEDEAEYYCT<br>LWYSNRWVFGGGTKLTVLGGGGSGGGGSGGGGSEVQLVE<br>SGGGLVQPGGSLKLSCAASGFTENKYAINWVRQAPGKGL<br>EWVARIRSKYNNYATYYADQVKDRFTISRDDSKNTAYLQ<br>MNNLKTEDTAVYYCVRHANFGNSYISYWAYWGQGTLVTV<br>SSGGGGSGGGSEVQLLESGGGLVQPGGSLTLSCAASGFI<br>FRAASMAWYRQSPGNERELVASISSGAFTNYADSVKARF<br>TISRDNSKNTLYLQMNSLRAEDTAVYYCGATFLRSDGHH<br>TINGQGTLVTVSSHHHHHH |

SEQUENCE LISTING (1140 sequences)

SEQ ID NO: 1 - protein, 8 aa, Unknown
  Description of Unknown: Protease cleavage site sequence
KRALGLPG

SEQ ID NO: 2 - protein, 40 aa, Unknown
  Description of Unknown: Protease cleavage site sequence
DEDEDEDEDEDEDEDERPLALWRSDRDRDRDRDRDRDRDR

SEQ ID NO: 3 - protein, 5 aa, Unknown
  Description of Unknown: Protease cleavage site sequence
  MOD_RES (3)..(3): Ser or Thr
  MOD_RES (4)..(4): Leu or Ile
  MOD_RES (5)..(5): Ser or Thr
PRXXX

SEQ ID NO: 4 - protein, 5 aa, Unknown
  Description of Unknown: Protease cleavage site sequence
LEATA

SEQ ID NO: 5 - protein, 10 aa, Unknown
  Description of Unknown: Protease cleavage site sequence
GGAANLVRGG

SEQ ID NO: 6 - protein, 10 aa, Unknown
  Description of Unknown: Protease cleavage site sequence
SGRIGFLRTA

SEQ ID NO: 7 - protein, 6 aa, Unknown
  Description of Unknown: Protease cleavage site sequence
PLGLAG

SEQ ID NO: 8 - protein, 6 aa, Unknown
  Description of Unknown: Protease cleavage site sequence
  MOD_RES (6)..(6): Any amino acid
PLGLAX

SEQ ID NO: 9 - protein, 6 aa, Unknown
  Description of Unknown: Protease cleavage site sequence
PLGCAG

SEQ ID NO: 10 - protein, 8 aa, Unknown
  Description of Unknown: Protease cleavage site sequence
ESPAYYTA

SEQ ID NO: 11 - protein, 6 aa, Unknown
  Description of Unknown: Protease cleavage site sequence
RLQLKL

SEQ ID NO: 12 - protein, 7 aa, Unknown
  Description of Unknown: Protease cleavage site sequence
RLQLKAC

SEQ ID NO: 13 - protein, 7 aa, Unknown
  Description of Unknown: Protease cleavage site sequence
  MOD_RES (3)..(3): Cit
  MOD_RES (5)..(5): Hof
EPXGXYL

SEQ ID NO: 14 - protein, 5 aa, Unknown
  Description of Unknown: Protease cleavage site sequence
SGRSA

SEQ ID NO: 15 - protein, 4 aa, Unknown
  Description of Unknown: Protease cleavage site sequence
DAFK

SEQ ID NO: 16 - protein, 5 aa, Unknown
  Description of Unknown: Protease cleavage site sequence
GGGRR

SEQ ID NO: 17 - protein, 4 aa, Unknown
  Description of Unknown: Protease cleavage site sequence
GFLG

SEQ ID NO: 18 - protein, 4 aa, Unknown
  Description of Unknown: Protease cleavage site sequence
ALAL

SEQ ID NO: 19 - protein, 2 aa, Unknown
  Description of Unknown: Protease cleavage site sequence
FK

SEQ ID NO: 20 - protein, 3 aa, Unknown
  Description of Unknown: Protease cleavage site sequence
NLL

SEQ ID NO: 21 - protein, 5 aa, Unknown
  Description of Unknown: Protease cleavage site sequence
PICFF

SEQ ID NO: 22 - protein, 8 aa, Unknown
  Description of Unknown: Protease cleavage site sequence
GGPRGLPG

SEQ ID NO: 23 - protein, 6 aa, Unknown
  Description of Unknown: Protease cleavage site sequence
HSSKLQ

SEQ ID NO: 24 - protein, 7 aa, Unknown
  Description of Unknown: Protease cleavage site sequence
HSSKLQL

SEQ ID NO: 25 - protein, 9 aa, Unknown
  Description of Unknown: Protease cleavage site sequence
HSSKLQEDA

SEQ ID NO: 26 - protein, 10 aa, Unknown
  Description of Unknown: Protease cleavage site sequence
LVLASSSFGY

SEQ ID NO: 27 - protein, 10 aa, Unknown
  Description of Unknown: Protease cleavage site sequence
GVSQNYPIVG

SEQ ID NO: 28 - protein, 10 aa, Unknown
  Description of Unknown: Protease cleavage site sequence
GVVQASCRLA

SEQ ID NO: 29 - protein, 4 aa, Unknown
  Description of Unknown: Protease cleavage site sequence
  MOD_RES (2)..(2): Pip
FXRS

SEQ ID NO: 30 - protein, 6 aa, Unknown
  Description of Unknown: Protease cleavage site sequence
DPRSFL

SEQ ID NO: 31 - protein, 6 aa, Unknown
  Description of Unknown: Protease cleavage site sequence
PPRSFL

SEQ ID NO: 32 - protein, 4 aa, Unknown
  Description of Unknown: Protease cleavage site sequence
DEVD

SEQ ID NO: 33 - protein, 5 aa, Unknown
  Description of Unknown: Protease cleavage site sequence
DEVDP

SEQ ID NO: 34 - protein, 8 aa, Unknown
  Description of Unknown: Protease cleavage site sequence
KGSGDVEG

SEQ ID NO: 35 - protein, 6 aa, Unknown
  Description of Unknown: Protease cleavage site sequence
GWEHDG

SEQ ID NO: 36 - protein, 7 aa, Unknown
  Description of Unknown: Protease cleavage site sequence
EDDDDKA

SEQ ID NO: 37 - protein, 9 aa, Unknown
  Description of Unknown: Protease cleavage site sequence
KQEQNPGST

SEQ ID NO: 38 - protein, 6 aa, Unknown
  Description of Unknown: Protease cleavage site sequence
GKAFRR

SEQ ID NO: 39 - protein, 4 aa, Unknown
  Description of Unknown: Protease cleavage site sequence
DAFK

SEQ ID NO: 40 - protein, 4 aa, Unknown
  Description of Unknown: Protease cleavage site sequence
DVLK

SEQ ID NO: 41 - protein, 4 aa, Unknown
  Description of Unknown: Protease cleavage site sequence
DAFK

SEQ ID NO: 42 - protein, 7 aa, Unknown
  Description of Unknown: Protease cleavage site sequence
ALLLALL

SEQ ID NO: 43 - protein, 518 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGKPLGLQARVVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLVESGGGLVQPGGSLTLSCAASRFMISEYHMHWVRQAPGKGLEWVSTINPAGTTDYAESVKGRFTISRDNAKNTLYLQMNSLKPEDTAVYYCDSYGYRGQGTQVTVSSHHHHHH

SEQ ID NO: 44 - protein, 518 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGSGGGGSGGVVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLVESGGGLVQPGGSLTLSCAASRFMISEYHMHWVRQAPGKGLEWVSTINPAGTTDYAESVKGRFTISRDNAKNTLYLQMNSLKPEDTAVYYCDSYGYRGQGTQVTVSSHHHHHH

SEQ ID NO: 45 - protein, 382 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLVESGGGLVQPGGSLTLSCAASRFMISEYHMHWVRQAPGKGLEWVSTINPAGTTDYAESVKGRFTISRDNAKNTLYLQMNSLKPEDTAVYYCDSYGYRGQGTQVTVSSHHHHHH

SEQ ID NO: 46 - protein, 534 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGKPLGLQARVVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLVESGGGLVQPGGSLTLSCAASGRTFSSYAMGWFRQAPGKEREFVVAINWASGSTYYADSVKGRFTISRDNSKNTLYLQMNSLRAEDTAVYYCAAGYQINSGNYNFKDYEYDYWGQGTLVTVSSHHHHHH

SEQ ID NO: 47 - protein, 534 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGSGGGGSGGVVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLVESGGGLVQPGGSLTLSCAASGRTFSSYAMGWFRQAPGKEREFVVAINWASGSTYYADSVKGRFTISRDNSKNTLYLQMNSLRAEDTAVYYCAAGYQINSGNYNFKDYEYDYWGQGTLVTVSSHHHHHH

SEQ ID NO: 48 - protein, 398 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLVESGGGLVQPGGSLTLSCAASGRTFSSYAMGWFRQAPGKEREFVVAINWASGSTYYADSVKGRFTISRDNSKNTLYLQMNSLRAEDTAVYYCAAGYQINSGNYNFKDYEYDYWGQGTLVTVSSHHHHHH

SEQ ID NO: 49 - protein, 503 aa, Artificial Sequence
  Description of Artificial Sequence: Synthetic polypeptide
QVQLVESGGALVQPGGSLRLSCAASGFPVNRYSMRWYRQAPGKEREWVAGMSSAGDRSSYEDSVKGRFTISRDDARNTVYLQMNSLKPEDTAVYYCNVNVGFEYWGQGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 50 - protein, 14 aa, Artificial Sequence
  Description of Artificial Sequence: Synthetic peptide
GGGGGLDGNEEPGG

SEQ ID NO: 51 - protein, 19 aa, Artificial Sequence
  Description of Artificial Sequence: Synthetic peptide
GGGGSGGGGSGGVVGGGGT

SEQ ID NO: 52 - protein, 509 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGGSGGVVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLVESGGGLVQPGGSLTLSCAASRFMISEYHMHWVRQAPGKGLEWVSTINPAGTTDYAESVKGRFTISRDNAKNTLYLQMNSLKPEDTAVYYCDSYGYRGQGTQVTVSSHHHHHH

SEQ ID NO: 53 - protein, 19 aa, Artificial Sequence
  Description of Artificial Sequence: Synthetic peptide
GGGGKPLGLQARVVGGGGT

SEQ ID NO: 54 - protein, 143 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGKPLGLQARVVGGGGT

SEQ ID NO: 55 - protein, 127 aa, Artificial Sequence
  Description of Artificial Sequence: Synthetic polypeptide
EVQLVESGGGLVQPGGSLTLSCAASGRTFSSYAMGWFRQAPGKEREFVVAINWASGSTYYADSVKGRFTISRDNSKNTLYLQMNSLRAEDTAVYYCAAGYQINSGNYNFKDYEYDYWGQGTLVTVSS

SEQ ID NO: 56 - protein, 249 aa, Artificial Sequence
  Description of Artificial Sequence: Synthetic polypeptide
QTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSS

SEQ ID NO: 57 - protein, 111 aa, Artificial Sequence
  Description of Artificial Sequence: Synthetic polypeptide
EVQLVESGGGLVQPGGSLTLSCAASRFMISEYHMHWVRQAPGKGLEWVSTINPAGTTDYAESVKGRFTISRDNAKNTLYLQMNSLKPEDTAVYYCDSYGYRGQGTQVTVSS

SEQ ID NO: 58 - protein, 10 aa, Unknown
  Description of Unknown: Protease cleavage site sequence
KPLGLQARVV

SEQ ID NO: 59 - protein, 10 aa, Unknown
  Description of Unknown: Protease cleavage site sequence
PQASTGRSGG

SEQ ID NO: 60 - protein, 10 aa, Unknown
  Description of Unknown: Protease cleavage site sequence
PQGSTGRAAG

SEQ ID NO: 61 - protein, 10 aa, Unknown
  Description of Unknown: Protease cleavage site sequence
PPASSGRAGG

SEQ ID NO: 62 - protein, 9 aa, Unknown
  Description of Unknown: Protease cleavage site sequence
PIPVQGRAH

SEQ ID NO: 63 - protein, 111 aa, Artificial Sequence
  Description of Artificial Sequence: Synthetic polypeptide
EVQLVESGGGLVQPGGSLRLSCAASRFMISEYHMHWVRQAPGKGLEWVSDINPAGTTDYAESVKGRFTISRDNAKNTLYLQMNSLRAEDTAVYYCDSYGYRGQGTLVTVSS

SEQ ID NO: 64 - protein, 111 aa, Artificial Sequence
  Description of Artificial Sequence: Synthetic polypeptide
EVQLVESGGGLVQPGGSLRLSCAASRFMISEYHMHWVRQAPGKGLEWVSTINPAGTTDYAESVKGRFTISRDNAKNTLYLQMNSLRAEDTAVYYCDSYGYRGQGTLVTVSS

SEQ ID NO: 65 - protein, 111 aa, Artificial Sequence
  Description of Artificial Sequence: Synthetic polypeptide
EVQLVESGGGLVQPGGSLRLSCAASRFMISEYSMHWVRQAPGKGLEWVSTINPAKTTDYAESVKGRFTISRDNAKNTLYLQMNSLRAEDTAVYYCDSYGYRGQGTLVTVSS

SEQ ID NO: 66 - protein, 111 aa, Artificial Sequence
  Description of Artificial Sequence: Synthetic polypeptide
EVQLVESGGGLVQPGGSLRLSCAASRFMISPYSMHWVRQAPGKGLEWVSTINPAGTTDYAESVKGRFTISRDNAKNTLYLQMNSLRAEDTAVYYCDGYGYRGQGTLVTVSS

SEQ ID NO: 67 - protein, 111 aa, Artificial Sequence
  Description of Artificial Sequence: Synthetic polypeptide
EVQLVESGGGLVQPGGSLRLSCAASRFMISEYSMHWVRQAPGKGLEWVSTINPAGQTDYAESVKGRFTISRDNAKNTLYLQMNSLRAEDTAVYYCDGYGYRGQGTLVTVSS

SEQ ID NO: 68 - protein, 111 aa, Artificial Sequence
  Description of Artificial Sequence: Synthetic polypeptide
EVQLVESGGGLVQPGGSLRLSCAASRFMISEYSMHWVRQAPGKGLEWVSTINPAGTTDYAEYVKGRFTISRDNAKNTLYLQMNSLRAEDTAVYYCDGYGYRGQGTLVTVSS

SEQ ID NO: 69 - protein, 111 aa, Artificial Sequence
  Description of Artificial Sequence: Synthetic polypeptide
EVQLVESGGGLVQPGGSLRLSCAASRFMISEYHMHWVRQAPGKGLEWVSDINPAKTTDYAESVKGRFTISRDNAKNTLYLQMNSLRAEDTAVYYCDSYGYRGQGTLVTVSS

SEQ ID NO: 70 - protein, 111 aa, Artificial Sequence
  Description of Artificial Sequence: Synthetic polypeptide
EVQLVESGGGLVQPGGSLRLSCAASRFMISPYHMHWVRQAPGKGLEWVSDINPAGTTDYAESVKGRFTISRDNAKNTLYLQMNSLRAEDTAVYYCDSYGYRGQGTLVTVSS

SEQ ID NO: 71 - protein, 111 aa, Artificial Sequence
  Description of Artificial Sequence: Synthetic polypeptide
EVQLVESGGGLVQPGGSLRLSCAASRFMISEYHMHWVRQAPGKGLEWVSDINPAGQTDYAESVKGRFTISRDNAKNTLYLQMNSLRAEDTAVYYCDSYGYRGQGTLVTVSS

SEQ ID NO: 72 - protein, 111 aa, Artificial Sequence
  Description of Artificial Sequence: Synthetic polypeptide
EVQLVESGGGLVQPGGSLRLSCAASRFMISEYHMHWVRQAPGKGLEWVSDINPAGTTDYAEYVKGRFTISRDNAKNTLYLQMNSLRAEDTAVYYCDSYGYRGQGTLVTVSS

SEQ ID NO: 73 - protein, 111 aa, Artificial Sequence
  Description of Artificial Sequence: Synthetic polypeptide
EVQLVESGGGLVQPGGSLTLSCAASRFMISEYHMHWVRQAPGKGLEWVSDINPAGTTDYAESVKGRFTISRDNAKNTLYLQMNSLKPEDTAVYYCDSYGYRGQGTQVTVSS

SEQ ID NO: 74 - protein, 249 aa, Artificial Sequence
  Description of Artificial Sequence: Synthetic polypeptide
EVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVL

SEQ ID NO: 75 - protein, 249 aa, Artificial Sequence
  Description of Artificial Sequence: Synthetic polypeptide
EVQLVESGGGLVQPGGSLKLSCAASGFEFNKYAMNWVRQAPGKGLEWVARIRSKYNKYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSFGAVTSGNYPNWVQQKPGQAPRGLIGGTKFLAPGTPARFSGSLLGGKAALTLSGVQPEDEAEYYCVLWYDNRWVFGGGTKLTVL

SEQ ID NO: 76 - protein, 249 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSHISYWAYWGQGTLVTVSSGGGGSGGGGSGGGGSQTVVTQEPSLTVSPGGTVTLTCGSSTGYVTSGNYPNWVQQKPGQAPRGLIGGTSFLAPGTPARFSGSLLGGKAALTLSGVQPEDEAEYYCVLWYSNRWIFGGGTKLTVL

SEQ ID NO: 77 - protein, 249 aa, Artificial Sequence
  Description of Artificial Sequence: Synthetic polypeptide
EVQLVESGGGLVQPGGSLKLSCAASGFMFNKYAMNWVRQAPGKGLEWVARIRSKSNNYATYYADSVKDRFTISRDDSKNTAYLQMNNLKTEDTAVYYCVRHGNFGNSYISYWATWGQGTLVTVSSGGGGSGGGGSGGGGSQTVVTQEPSLTVSPGGTVTLTCGSSFGAVTSGNYPNWVQQKPGQAPRGLIGGTKLLAPGTPARFSGSLLGGKAALTLSGVQPEDEAEYYCVLWYSNSWVFGGGTKLTVL

SEQ ID NO: 78 - protein, 249 aa, Artificial Sequence
  Description of Artificial Sequence: Synthetic polypeptide
EVQLVESGGGLVQPGGSLKLSCAASGFTFNTYAMNWVRQAPGKGLEWVARIRSKYNNYATYYKDSVKDRFTISRDDSKNTAYLQMNNLKTEDTAVYYCVRHGNFGNSPISYWAYWGQGTLVTVSSGGGGSGGGGSGGGGSQTVVTQEPSLTVSPGGTVTLTCGSSTGAVVSGNYPNWVQQKPGQAPRGLIGGTEFLAPGTPARFSGSLLGGKAALTLSGVQPEDEAEYYCVLWYSNRWVFGGGTKLTVL

SEQ ID NO: 79 - protein, 249 aa, Artificial Sequence
  Description of Artificial Sequence: Synthetic polypeptide
EVQLVESGGGLVQPGGSLKLSCAASGFTYNKYAMNWVRQAPGKGLEWVARIRSKYNNYATYYADEVKDRFTISRDDSKNTAYLQMNNLKTEDTAVYYCVRHGNFGNSPISYWAYWGQGTLVTVSSGGGGSGGGGSGGGGSQTVVTQEPSLTVSPGGTVTLTCGSSKGAVTSGNYPNWVQQKPGQAPRGLIGGTKELAPGTPARFSGSLLGGKAALTLSGVQPEDEAEYYCTLWYSNRWVFGGGTKLTVL

SEQ ID NO: 80 - protein, 249 aa, Artificial Sequence
  Description of Artificial Sequence: Synthetic polypeptide
EVQLVESGGGLVQPGGSLKLSCAASGNTFNKYAMNWVRQAPGKGLEWVARIRSKYNNYETYYADSVKDRFTISRDDSKNTAYLQMNNLKTEDTAVYYCVRHTNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTYFLAPGTPARFSGSLLGGKAALTLSGVQPEDEAEYYCVLWYSNRWVFGGGTKLTVL

SEQ ID NO: 81 - protein, 249 aa, Artificial Sequence
  Description of Artificial Sequence: Synthetic polypeptide
EVQLVESGGGLVQPGGSLKLSCAASGFTFNNYAMNWVRQAPGKGLEWVARIRSKYNNYATYYADAVKDRFTISRDDSKNTAYLQMNNLKTEDTAVYYCVRHGNFGNSQISYWAYWGQGTLVTVSSGGGGSGGGGSGGGGSQTVVTQEPSLTVSPGGTVTLTCGSSTGAVTDGNYPNWVQQKPGQAPRGLIGGIKFLAPGTPARFSGSLLGGKAALTLSGVQPEDEAEYYCVLWYSNRWVFGGGTKLTVL

SEQ ID NO: 82 - protein, 249 aa, Artificial Sequence
  Description of Artificial Sequence: Synthetic polypeptide
EVQLVESGGGLVQPGGSLKLSCAASGFTFNKYAVNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGESTGAVTSGNYPNWVQQKPGQAPRGLIGGTKILAPGTPARFSGSLLGGKAALTLSGVQPEDEAEYYCVLWYSNRWVFGGGTKLTVL

SEQ ID NO: 83 - protein, 249 aa, Artificial Sequence
  Description of Artificial Sequence: Synthetic polypeptide
EVQLVESGGGLVQPGGSLKLSCAASGFTFNKYPMNWVRQAPGKGLEWVARIRSKYNNYATYYADSVKDRFTISRDDSKNTAYLQMNNLKNEDTAVYYCVRHGNFNNSYISYWAYWGQGTLVTVSSGGGGSGGGGSGGGGSQTVVTQEPSLTVSPGGTVTLTCGSSTGAVTKGNYPNWVQQKPGQAPRGLIGGTKMLAPGTPARFSGSLLGGKAALTLSGVQPEDEAEYYCALWYSNRWVFGGGTKLTVL

SEQ ID NO: 84 - protein, 249 aa, Artificial Sequence
  Description of Artificial Sequence: Synthetic polypeptide
EVQLVESGGGLVQPGGSLKLSCAASGFTFNGYAMNWVRQAPGKGLEWVARIRSKYNNYATYYADEVKDRFTISRDDSKNTAYLQMNNLKTEDTAVYYCVRHGNFGNSPISYWAYWGQGTLVTVSSGGGGSGGGGSGGGGSQTVVTQEPSLTVSPGGTVTLTCGSSTGAVVSGNYPNWVQQKPGQAPRGLIGGTEFLAPGTPARFSGSLLGGKAALTLSGVQPEDEAEYYCVLWYSNRWVFGGGTKLTVL

SEQ ID NO: 85 - protein, 249 aa, Artificial Sequence
  Description of Artificial Sequence: Synthetic polypeptide
EVQLVESGGGLVQPGGSLKLSCAASGNTFNKYAMNWVRQAPGKGLEWVARIRSKYNNYATYYADSVKDRFTISRDDSKNTAYLQMNNLKTEDTAVYYCVRHGNFGDSYISYWAYWGQGTLVTVSSGGGGSGGGGSGGGGSQTVVTQEPSLTVSPGGTVTLTCGSSTGAVTHGNYPNWVQQKPGQAPRGLIGGTKVLAPGTPARFSGSLLGGKAALTLSGVQPEDEAEYYCVLWYSNRWVFGGGTKLTVL

SEQ ID NO: 86 - protein, 249 aa, Artificial Sequence
  Description of Artificial Sequence: Synthetic polypeptide
EVQLVESGGGLVQPGGSLKLSCAASGFTFNNYAMNWVRQAPGKGLEWVARIRSGYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSYTGAVTSGNYPNWVQQKPGQAPRGLIGGTKFNAPGTPARFSGSLLGGKAALTLSGVQPEDEAEYYCVLWYANRWVFGGGTKLTVL

SEQ ID NO: 87 - protein, 249 aa, Artificial Sequence
  Description of Artificial Sequence: Synthetic polypeptide
EVQLVESGGGLVQPGGSLKLSCAASGFEFNKYAMNWVRQAPGKGLEWVARIRSKYNNYETYYADSVKDRFTISRDDSKNTAYLQMNNLKTEDTAVYYCVRHGNFGNSLISYWAYWGQGTLVTVSSGGGGSGGGGSGGGGSQTVVTQEPSLTVSPGGTVTLTCGSSSGAVTSGNYPNWVQQKPGQAPRGLIGGTKFGAPGTPARFSGSLLGGKAALTLSGVQPEDEAEYYCVLWYSNRWVFGGGTKLTVL

SEQ ID NO: 88 - protein, 249 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 89 - protein, 249 aa, Artificial Sequence
  Description of Artificial Sequence: Synthetic polypeptide
EVQLVESGGGLVQPGGSLKLSCAASGFTFNKYALNWVRQAPGKGLEWVARIRSKYNNYATEYADSVKDRFTISRDDSKNTAYLQMNNLKTEDTAVYYCVRHGNFGNSPISYWAYWGQGTLVTVSSGGGGSGGGGSGGGGSQTVVTQEPSLTVSPGGTVTLTCGSSTGAVTSGNYPNWVQQKPGQAPRGLIGGTNFLAPGTPERFSGSLLGGKAALTLSGVQPEDEAEYYCVLWYSNRWAFGGGTKLTVL

SEQ ID NO: 90 - protein, 249 aa, Artificial Sequence
  Description of Artificial Sequence: Synthetic polypeptide
EVQLVESGGGLVQPGGSLKLSCAASGFTFNEYAMNWVRQAPGKGLEWVARIRSKYNNYATYYADDVKDRFTISRDDSKNTAYLQMNNLKTEDTAVYYCVRHGNFGNSGISYWAYWGQGTLVTVSSGGGGSGGGGSGGGGSQTVVTQEPSLTVSPGGTVTLTCGSSTGAVTVGNYPNWVQQKPGQAPRGLIGGTEFLAPGTPARFSGSLLGGKAALTLSGVQPEDEAEYYCVLWYSNRWVFGGGTKLTVL

SEQ ID NO: 91 - protein, 119 aa, Artificial Sequence
  Description of Artificial Sequence: Synthetic polypeptide
EVQLVESGGGLVQPGRSLTLSCAASTNIFSISPMGWYRQAPGKQRELVAAIHGFSTLYADSVKGRFTISRDNAKNSIYLQMNSLRPEDTALYYCNKVPWGDYHPRNVYWGQGTQVTVSS

SEQ ID NO: 92 - protein, 119 aa, Artificial Sequence
  Description of Artificial Sequence: Synthetic polypeptide
EVQLVESGGGLVQPGRSLTLSCAASTDIFSISPMGWYRQAPGKQRELVAAIHGGSTLYADSVKGRFTISRDNAKNSIYLQMNSLRPEDTALYYCNKVPWGDYHPRNVAWGQGTQVTVSS

SEQ ID NO: 93 - protein, 119 aa, Artificial Sequence
  Description of Artificial Sequence: Synthetic polypeptide
EVQLVESGGGLVQPGRSLTLSCAASTNDFSISPMGWYRQAPGKQRELVAAIHGGSTLYADSVKGRFTISRDNAKNSIYLQMNSLRPEDTALYYCNKVPWGDYHPRNVAWGQGTQVTVSS

SEQ ID NO: 94 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGKSTLYADSVKGRFTISRDNAKNSIYLQMNSLRPEDTALYYCNKVPWGDYHPRNVVWGQGTQVTVSS

SEQ ID NO: 95 - protein, 119 aa, Artificial Sequence
  Description of Artificial Sequence: Synthetic polypeptide
EVQLVESGGGLVQPGRSLTLSCAASTNDFSISPMGWYRQAPGKQRELVAAIHGKSTLYADSVKGRFTISRDNAKNSIYLQMNSLRPEDTALYYCNKVPWGDYHPRNVKWGQGTQVTVSS

SEQ ID NO: 96 - protein, 119 aa, Artificial Sequence
  Description of Artificial Sequence: Synthetic polypeptide
EVQLVESGGGLVQPGRSLTLSCAASTNQFSISPMGWYRQAPGKQRELVAAIHGKSTLYADSVKGRFTISRDNAKNSIYLQMNSLRPEDTALYYCNKVPWGDYHPRNVVWGQGTQVTVSS

SEQ ID NO: 97 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAINGFSTLYADSVKGRFTISRDNAKNSIYLQMNSLRPEDTALYYCNKVPWGDYHPRNVHWGQGTQVTVSS

SEQ ID NO: 98 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGFSTLYADSVKGRFTISRDNAKNSIYLQMNSLRPEDTALYYCNKVPWGDYHPRNVYWGQGTQVTVSS

SEQ ID NO: 99 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGFQTLYADSVKGRFTISRDNAKNSIYLQMNSLRPEDTALYYCNKVPWGDYHPRNVVWGQGTQVTVSS

SEQ ID NO: 100 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGFETLYADSVKGRFTISRDNAKNSIYLQMNSLRPEDTALYYCNKVPWGDYHPRNVLWGQGTQVTVSS

SEQ ID NO: 101 - protein, 119 aa, Artificial Sequence
  Description of Artificial Sequence: Synthetic polypeptide
EVQLVESGGGLVQPGRSLTLSCAASTNIFSESPMGWYRQAPGKQRELVAAIHGFTTLYADSVKGRFTISRDNAKNSIYLQMNSLRPEDTALYYCNKVPWGDYHPRNVTWGQGTQVTVSS

SEQ ID NO: 102 - protein, 119 aa, Artificial Sequence
  Description of Artificial Sequence: Synthetic polypeptide
EVQLVESGGGLVQPGRSLTLSCAASTNIFSDSPMGWYRQAPGKQRELVAAIHGFSTLYADSVKGRFTISRDNAKNSIYLQMNSLRPEDTALYYCNKVPWGDYHPRNVAWGQGTQVTVSS

SEQ ID NO: 103 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGGSTLYADSVKGRFTISRDNAKNSIYLQMNSLRPEDTALYYCNKVPWGDYHPRNVHWGQGTQVTVSS

SEQ ID NO: 104 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGRSTLYADSVKGRFTISRDNAKNSIYLQMNSLRPEDTALYYCNKVPWGDYHPRNVMWGQGTQVTVSS

SEQ ID NO: 105 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGPSTLYADSVKGRFTISRDNAKNSIYLQMNSLRPEDTALYYCNKVPWGDYHPRNVTWGQGTQVTVSS

SEQ ID NO: 106 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGDSTLYADSVKGRFTISRDNAKNSIYLQMNSLRPEDTALYYCNKVPWGDYHPRNVRWGQGTQVTVSS

SEQ ID NO: 107 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGDSTLYADSVKGRFTISRDNAKNSIYLQMNSLRPEDTALYYCNKVPWGDYHPRNVTWGQGTQVTVSS

SEQ ID NO: 108 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGQSTLYADSVKGRFTISRDNAKNSIYLQMNSLRPEDTALYYCNKVPWGDYHPRNVTWGQGTQVTVSS

SEQ ID NO: 109 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGHSTLYADSVKGRFTISRDNAKNSIYLQMNSLRPEDTALYYCNKVPWGDYHPRNVTWGQGTQVTVSS

SEQ ID NO: 110 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGESTLYADSVKGRFTISRDNAKNSIYLQMNSLRPEDTALYYCNKVPWGDYHPRKVYWGQGTQVTVSS

SEQ ID NO: 111 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGNSTLYADSVKGRFTISRDNAKNSIYLQMNSLRPEDTALYYCNKVPWGIYHPRNVYWGQGTQVTVSS

SEQ ID NO: 112 - protein, 119 aa, Artificial Sequence
  Description of Artificial Sequence: Synthetic polypeptide
EVQLVESGGGLVQPGRSLTLSCAASTNIFSESPMGWYRQAPGKQRELVAAIHGNSTLYADSVKGRFTISRDNAKNSIYLQMNSLRPEDTALYYCNKVPWGTYHPRNVYWGQGTQVTVSS

SEQ ID NO: 113 - protein, 119 aa, Artificial Sequence
  Description of Artificial Sequence: Synthetic polypeptide
EVQLVESGGGLVQPGRSLTLSCAASTNIFSVSPMGWYRQAPGKQRELVAAIHGNSTLYADSVKGRFTISRDNAKNSIYLQMNSLRPEDTALYYCNKVPWGKYHPRNVYWGQGTQVTVSS

SEQ ID NO: 114 - protein, 119 aa, Artificial Sequence
  Description of Artificial Sequence: Synthetic polypeptide
EVQLVESGGGLVQPGRSLTLSCAASTNIFSVSPMGWYRQAPGKQRELVAAIHGNSTLYADSVKGRFTISRDNAKNSIYLQMNSLRPEDTALYYCNKVPWGDYHPRNVYWGQGTQVTVSS

SEQ ID NO: 115 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGNSTLYADSVKGRFTISRDNAKNSIYLQMNSLRPEDTALYYCNKVPWGDYHPREVYWGQGTQVTVSS

SEQ ID NO: 116 - protein, 119 aa, Artificial Sequence
  Description of Artificial Sequence: Synthetic polypeptide
EVQLVESGGGLVQPGRSLTLSCAASTNIFSDSPMGWYRQAPGKQRELVAAIHGTSTLYADSVKGRFTISRDNAKNSIYLQMNSLRPEDTALYYCNKVPWGDYHPRNVYWGQGTQVTVSS

SEQ ID NO: 117 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGTSTLYADSVKGRFTISRDNAKNSIYLQMNSLRPEDTALYYCNKVPWGKYHPRNVYWGQGTQVTVSS

SEQ ID NO: 118 - protein, 119 aa, Artificial Sequence
  Description of Artificial Sequence: Synthetic polypeptide
EVQLVESGGGLVQPGRSLTLSCAASTNIFSHSPMGWYRQAPGKQRELVAAIHGTSTLYADSVKGRFTISRDNAKNSIYLQMNSLRPEDTALYYCNKVPWGRYHPRNVYWGQGTQVTVSS

SEQ ID NO: 119 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 120 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGTSTLYADSVKGRFTISRDNAKNSIYLQMNSLRPEDTALYYCNKVPWGDYHPRNVQWGQGTQVTVSS

SEQ ID NO: 121 - protein, 119 aa, Artificial Sequence
  Description of Artificial Sequence: Synthetic polypeptide
EVQLVESGGGLVQPGRSLTLSCAASTNIFSLSPMGWYRQAPGKQRELVAAIHGDSTLYADSVKGRFTISRDNAKNSIYLQMNSLRPEDTALYYCNKVPWGDYHPRNVYWGQGTQVTVSS

SEQ ID NO: 122 - protein, 119 aa, Artificial Sequence
  Description of Artificial Sequence: Synthetic polypeptide
EVQLVESGGGLVQPGRSLTLSCAASTNIFSISPGGWYRQAPGKQRELVAAIHGSSTLYADSVKGRFTISRDNAKNSIYLQMNSLRPEDTALYYCNKVPWGDYHPRNVYWGQGTQVTVSS

SEQ ID NO: 123 - protein, 119 aa, Artificial Sequence
  Description of Artificial Sequence: Synthetic polypeptide
EVQLVESGGGLVQPGRSLTLSCAASTNHFSISPMGWYRQAPGKQRELVAAIHGSSTLYADSVKGRFTISRDNAKNSIYLQMNSLRPEDTALYYCNKVPWGDYHPRVVYWGQGTQVTVSS

SEQ ID NO: 124 - protein, 119 aa, Artificial Sequence
  Description of Artificial Sequence: Synthetic polypeptide
EVQLVESGGGLVQPGRSLTLSCAASTNIFSASPMGWYRQAPGKQRELVAAIHGSSTLYADSVKGRFTISRDNAKNSIYLQMNSLRPEDTALYYCNKVPWGDYHPRNVNWGQGTQVTVSS

SEQ ID NO: 125 - protein, 119 aa, Artificial Sequence
  Description of Artificial Sequence: Synthetic polypeptide
EVQLVESGGGLVQPGRSLTLSCAASTNIFSASPMGWYRQAPGKQRELVAAIHGSSTLYADSVKGRFTISRDNAKNSIYLQMNSLRPEDTALYYCNKVPWGRYHPRNVYWGQGTQVTVSS

SEQ ID NO: 126 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 127 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 128 - protein, 119 aa, Artificial Sequence
  Description of Artificial Sequence: Synthetic polypeptide
EVQLVESGGGLVQPGRSLTLSCAASTNIFSISPYGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 129 - protein, 119 aa, Artificial Sequence
  Description of Artificial Sequence: Synthetic polypeptide
EVQLVESGGGLVQPGRSLTLSCAASTNIASISPMGWYRQAPGKQRELVAAIHGTSTLYADSVKGRFTISRDNAKNSIYLQMNSLRPEDTALYYCNKVPWGDYHPGNVYWGQGTQVTVSS

SEQ ID NO: 130 - protein, 119 aa, Artificial Sequence
  Description of Artificial Sequence: Synthetic polypeptide
EVQLVESGGGLVQPGRSLTLSCAASTNIASISPMGWYRQAPGKQRELVAAIHGKSTLYADSVKGRFTISRDNAKNSIYLQMNSLRPEDTALYYCNKVPWGDYHPGNVYWGQGTQVTVSS

SEQ ID NO: 131 - protein, 119 aa, Artificial Sequence
  Description of Artificial Sequence: Synthetic polypeptide
EVQLVESGGGLVQPGRSLTLSCAASTNIASISPMGWYRQAPGKQRELVAAIHGSSTLYADSVKGRFTISRDNAKNSIYLQMNSLRPEDTALYYCNKVPWGDYHPGNVYWGQGTQVTVSS

SEQ ID NO: 132 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGDSTLYADSVKGRFTISRDNAKNSIYLQMNSLRPEDTALYYCNKVPWGDYHPGNVYWGQGTQVTVSS

SEQ ID NO: 133 - protein, 119 aa, Artificial Sequence
  Description of Artificial Sequence: Synthetic polypeptide
EVQLVESGGGLVQPGRSLTLSCAASTNIMSISPMGWYRQAPGKQRELVAAIHGNSTLYADSVKGRFTISRDNAKNSIYLQMNSLRPEDTALYYCNKVPWGDYHPGNVYWGQGTQVTVSS

SEQ ID NO: 134 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGNSTLYADSVKGRFTISRDNAKNSIYLQMNSLRPEDTALYYCNKVPWGDYHPGNVYWGQGTQVTVSS

SEQ ID NO: 135 - protein, 119 aa, Artificial Sequence
  Description of Artificial Sequence: Synthetic polypeptide
EVQLVESGGGLVQPGRSLTLSCAASTNIVSISPMGWYRQAPGKQRELVAAIHGHSTLYADSVKGRFTISRDNAKNSIYLQMNSLRPEDTALYYCNKVPWGDYHPGNVYWGQGTQVTVSS

SEQ ID NO: 136 - protein, 119 aa, Artificial Sequence
  Description of Artificial Sequence: Synthetic polypeptide
EVQLVESGGGLVQPGRSLTLSCAASTNIVSISPMGWYRQAPGKQRELVAAIHGKSTLYADSVKGRFTISRDNAKNSIYLQMNSLRPEDTALYYCNKVPWGDYHPGNVYWGQGTQVTVSS

SEQ ID NO: 137 - protein, 119 aa, Artificial Sequence
  Description of Artificial Sequence: Synthetic polypeptide
EVQLVESGGGLVQPGRSLTLSCAASTNVVSISPMGWYRQAPGKQRELVAAIHGKSTLYADSVKGRFTISRDNAKNSIYLQMNSLRPEDTALYYCNKVPWGDYHPNNVYWGQGTQVTVSS

SEQ ID NO: 138 - protein, 119 aa, Artificial Sequence
  Description of Artificial Sequence: Synthetic polypeptide
EVQLVESGGGLVQPGRSLTLSCAASTNIISISPMGWYRQAPGKQRELVAAIHGASTLYADSVKGRFTISRDNAKNSIYLQMNSLRPEDTALYYCNKVPWGDYHPGNVYWGQGTQVTVSS

SEQ ID NO: 139 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGASTLYADSVKGRFTISRDNAKNSIYLQMNSLRPEDTALYYCNKVPWGDYHPGNVYWGQGTQVTVSS

SEQ ID NO: 140 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGFETLYADSVKGRFTISRDNAKNSIYLQMNSLRPEDTALYYCNKVPWGDYHPGNVYWGQGTQVTVSS

SEQ ID NO: 141 - protein, 119 aa, Artificial Sequence
  Description of Artificial Sequence: Synthetic polypeptide
EVQLVESGGGLVQPGRSLTLSCAASTNIQSISPMGWYRQAPGKQRELVAAIHGFETLYADSVKGRFTISRDNAKNSIYLQMNSLRPEDTALYYCNKVPWGDYHPGNVYWGQGTQVTVSS

SEQ ID NO: 142 - protein, 119 aa, Artificial Sequence
  Description of Artificial Sequence: Synthetic polypeptide
EVQLVESGGGLVQPGRSLTLSCAASTSDFSISPMGWYRQAPGKQRELVAAIHGFETLYADSVKGRFTISRDNAKNSIYLQMNSLRPEDTALYYCNKVPWGDYHPGNVYWGQGTQVTVSS

SEQ ID NO: 143 - protein, 119 aa, Artificial Sequence
  Description of Artificial Sequence: Synthetic polypeptide
EVQLVESGGGLVQPGRSLTLSCAASTNIDSISPMGWYRQAPGKQRELVAAIHGFQTLYADSVKGRFTISRDNAKNSIYLQMNSLRPEDTALYYCNKVPWGDYHPGNVYWGQGTQVTVSS

SEQ ID NO: 144 - protein, 119 aa, Artificial Sequence
  Description of Artificial Sequence: Synthetic polypeptide
EVQLVESGGGLVQPGRSLTLSCAASTNIMSISPMGWYRQAPGKQRELVAAIHGFSTVYADSVKGRFTISRDNAKNSIYLQMNSLRPEDTALYYCNKVPWGDYHPGNVYWGQGTQVTVSS

SEQ ID NO: 145 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGFSTLYADSVKGRFTISRDNAKNSIYLQMNSLRPEDTALYYCNKVPWGDYHPGNVYWGQGTQVTVSS

SEQ ID NO: 146 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGFKTLYADSVKGRFTISRDNAKNSIYLQMNSLRPEDTARYYCNKVPWGDYHPGNVYWGQGTQVTVSS

SEQ ID NO: 147 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGFSTLYADSVKGRFTISRDNAKNSIYLQMNSLRPEDTALYYCNKVPWGDYHPGNVYWGQGTQVTVSS

SEQ ID NO: 148 - protein, 119 aa, Artificial Sequence
  Description of Artificial Sequence: Synthetic polypeptide
EVQLVESGGGLVQPGRSLTLSCAASTNIFSNSPMGWYRQAPGKQRELVAAIHGFSTLYADSVKGRFTISRDNAKNSIYLQMNSLRPEDTALYYCNKVPWGDYHPGNVYWGQGTQVTVSS

SEQ ID NO: 149 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGFSTIYADSVKGRFTISRDNAKNSIYLQMNSLRPEDTALYYCNKVPWGDYHPGNVYWGQGTQVTVSS

SEQ ID NO: 150 - protein, 119 aa, Artificial Sequence
  Description of Artificial Sequence: Synthetic polypeptide
EVQLVESGGGLVQPGRSLTLSCAASTNIFSTSPMGWYRQAPGKQRELVAAIHGFSTIYADSVKGRFTISRDNAKNSIYLQMNSLRPEDTALYYCNKVPWGDYHPLNVYWGQGTQVTVSS

SEQ ID NO: 151 - protein, 119 aa, Artificial Sequence
  Description of Artificial Sequence: Synthetic polypeptide
EVQLVESGGGLVQPGRSLTLSCVASTNIFSTSPMGWYRQAPGKQRELVAAIHGFSTLYADSVKGRFTISRDNAKNSIYLQMNSLRPEDTALYYCNKVPWGDYHPGNVYWGQGTQVTVSS

SEQ ID NO: 152 - protein, 119 aa, Artificial Sequence
  Description of Artificial Sequence: Synthetic polypeptide
EVQLVESGGGLVQPGRSLTLSCAASTNIFSDSPMGWYRQAPGKQRELVAAIHGFSTFYADSVKGRFTISRDNAKNSIYLQMNSLRPEDTALYYCNKVPWGDYHPGNVYWGQGTQVTVSS

SEQ ID NO: 153 - protein, 119 aa, Artificial Sequence
  Description of Artificial Sequence: Synthetic polypeptide
EVQLVESGGGLVQPGRSLTLSCAASTNIFSQSPMGWYRQAPGKQRELVAAIHGDSTLYADSVKGRFTISRDNAKNSIYLQMNSLRPEDTALYYCNKVPWGDYHPGNVCWGQGTQVTVSS

SEQ ID NO: 154 - protein, 119 aa, Artificial Sequence
  Description of Artificial Sequence: Synthetic polypeptide
EVQLVESGGGLVQPGRSLTLSCAASTNIFSQSPMGWYRQAPGKQRELVAAIHGKSTLYADSVKGRFTISRDNAKNSIYLQMNSLRPEDTALYYCNKVPWGDYHPSNVYWGKGTQVTVSS

SEQ ID NO: 155 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGESTLYADSVKGRFTISRDNAKNSIYLQMNSLRPEDTALYYCNKVPWGRYHPGNVYWGQGTQVTVSS

SEQ ID NO: 156 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGISTLYADSVKGRFTISRDNAKNSIYLQMNSLRPEDTALYYCNKVPWGDYHPGNVYWGQGTQVTVSS

SEQ ID NO: 157 - protein, 119 aa, Artificial Sequence
  Description of Artificial Sequence: Synthetic polypeptide
EVQLVESGGGLVQPGRSLTLSCAASTNIFSRSPMGWYRQAPGKQRELVAAIHGSSTLYADSVKGRFTISRDNAKNSIYLQMNSLRPEDTALYYCNKVPWGDYHPGNVYWGQGTQVTVSS

SEQ ID NO: 158 - protein, 119 aa, Artificial Sequence
  Description of Artificial Sequence: Synthetic polypeptide
EVQLVESGGGLVQPGRSLTLSCAASTNIFSGSPMGWYRQAPGKQRELVAAIHGNSTLYADSVKGRFTISRDNAKNSIYLQMNSLRPEDTALYYCNKVPWGDYHPGNVYWGQGTQVTVSS

SEQ ID NO: 159 - protein, 119 aa, Artificial Sequence
  Description of Artificial Sequence: Synthetic polypeptide
EVQLVESGGGLVQPGRSLTLSCAASSNIFSISPMGWYRQAPGKQRELVAAIHGSSTLYADSVKGRFTISRDNAKNSIYLQMNSLRPEDTALYYCNKVPWGDYHPGNVYWGQGTQVTVSS

SEQ ID NO: 160 - protein, 119 aa, Artificial Sequence
  Description of Artificial Sequence: Synthetic polypeptide
EVQLVESGGGLVQPGRSLTLSCAASTNIFSIYPMGWYRQAPGKQRELVAAIHGSSTLYADSVKGRFTISRDNAKNSIYLQMNSLRPEDTALYYCNKVPWGDYHPKNVYWGQGTQVTVSS

SEQ ID NO: 161 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGSSTLYADSVKGRFTISRDNAKNSIYLQMNSLRPEDTALYYCNKVPWGDYHPGNVYWGQGTQVTVSS

SEQ ID NO: 162 - protein, 119 aa, Artificial Sequence
  Description of Artificial Sequence: Synthetic polypeptide
EVQLVESGGGLVQPGRSLTLSCAASTNIFSKSPMGWYRQAPGKQRELVAAIHGSSTLYADSVKGRFTISRDNAKNSIYLQMNSLRPEDTALYYCNKVPWGDYHPRNVYWGQGTQVTVSS

SEQ ID NO: 163 - protein, 119 aa, Artificial Sequence
  Description of Artificial Sequence: Synthetic polypeptide
EVQLVESGGGLVQPGRSLTLSCAASTNEFSISPMGWYRQAPGKQRELVAAIHGLSTLYADSVKGRFTISRDNAKNSIYLQMNSLRPEDTALYYCNKVPWGAYHPRNVYWGQGTQVTVSS

SEQ ID NO: 164 - protein, 119 aa, Artificial Sequence
  Description of Artificial Sequence: Synthetic polypeptide
EVQLVESGGGLVQPGRSLTLSCAASTNEFSISPMGWYRQAPGKQRELVAAIHGESTLYADSVKGRFTISRDNAKNSIYLQMNSLRPEDTALYYCNKVPWGDYHPGNVYWGQGTQVTVSS

SEQ ID NO: 165 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGESTLYADSVKGRFTISRDNAKNSIYLQMNSLRPEDTALYYCNKVPWGDYHPRNVAWGQGTQVTVSS

SEQ ID NO: 166 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGASTLYADSVKGRFTISRDNAKNSIYLQMNSLRPEDTALYYCNKVPWGDYHPRNVAWGQGTQVTVSS

SEQ ID NO: 167 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGESTLYADSVKGRFTISRDNAKNSIYLQMNSLRPEDTALYYCNKVPWGDYHPRNVYWGQGTQVTVSS

SEQ ID NO: 168 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGDSTLYADSVKGRFTISRDNAKNSIYLQMNSLRPEDTALYYCNKVPWGDYHPRNVYWGQGTQVTVSS

SEQ ID NO: 169 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGVSTLYADSVKGRFTISRDNAKNSIYLQMNSLRPEDTALYYCNKVPWGDYHPRNVQWGQGTQVTVSS

SEQ ID NO: 170 - protein, 119 aa, Artificial Sequence
  Description of Artificial Sequence: Synthetic polypeptide
EVQLVESGGGLVQPGRSLTLSCAASTNIPSISPMGWYRQAPGKQRELVAAIHGQSTLYADSVKGRFTISRDNAKNSIYLQMNSLRPEDTALYYCNKVPWGDYHPRNVQWGQGTQVTVSS

SEQ ID NO: 171 - protein, 119 aa, Artificial Sequence
  Description of Artificial Sequence: Synthetic polypeptide
EVQLVESGGGLVQPGRSLTLSCAASTNIVSISPMGWYRQAPGKQRELVAAIHGDSTLYADSVKGRFTISRDNAKNSIYLQMNSLRPEDTALYYCNKVPWGDYHPRNVSWGQGTQVTVSS

SEQ ID NO: 172 - protein, 119 aa, Artificial Sequence
  Description of Artificial Sequence: Synthetic polypeptide
EVQLVESGGGLVQPGRSLTLSCAASSNIFSISPMGWYRQAPGKQRELVAAIHGESTLYADSVKGRFTISRDNAKNSIYLQMNSLRPEDTALYYCNKVPWGDYHPRNVTWGQGTQVTVSS

SEQ ID NO: 173 - protein, 119 aa, Artificial Sequence
  Description of Artificial Sequence: Synthetic polypeptide
EVQLVESGGGLVQPGRSLTLSCAASTNIDSISPMGWYRQAPGKQRELVAAIHGESTLYADSVKGRFTISRDNAKNSIYLQMNSLRPEDTALYYCNKVPWGDYHPRNVTWGQGTQVTVSS

SEQ ID NO: 174 - protein, 119 aa, Artificial Sequence
  Description of Artificial Sequence: Synthetic polypeptide
EVQLVESGGGLVQPGRSLTLSCAASTNIDSISPMGWYRQAPGKQRELVAAIHGSSTLYADSVKGRFTISRDNAKNSIYLQMNSLRPEDTALYYCNKVPWGDYHPRNVTWGQGTQVTVSS

SEQ ID NO: 175 - protein, 119 aa, Artificial Sequence
  Description of Artificial Sequence: Synthetic polypeptide
EVQLVESGGGLVQPGRSLTLSCAASTNIRSISPMGWYRQAPGKQRELVAAIHGSSTLYADSVKGRFTISRDNAKNSIYLQMNSLRPEDTALYYCNKVPWGDYHPRNVVWGQGTQVTVSS

SEQ ID NO: 176 - protein, 119 aa, Artificial Sequence
  Description of Artificial Sequence: Synthetic polypeptide
EVQLVESGGGLVQPGRSLTLSCAASTNITSISPMGWYRQAPGKQRELVAAISGFSTLYADSVKGRFTISRDNAKNSIYLQMNSLRPEDTALYYCNEVPWGDYHPRNVYWGQGTQVTVSS

SEQ ID NO: 177 - protein, 119 aa, Artificial Sequence
  Description of Artificial Sequence: Synthetic polypeptide
EVQLVESGGGLVQPGRSLTLSCAASTNITSISPMGWYRQAPGKQRELVAAIHGESTLYADSVKGRFTISRDNAKNSIYLQMNSLRPEDTALYYCNKVPWGDYHPRNVYWGQGTQVTVSS

SEQ ID NO: 178 - protein, 119 aa, Artificial Sequence
  Description of Artificial Sequence: Synthetic polypeptide
EVQLVESGGGLVQPGRSLTLSCAASTNITSVSPMGWYRQAPGKQRELVAAIHGPSTLYADSVKGRFTISRDNAKNSIYLQMNSLRPEDTALYYCNKVPWGDYHPTNVYWGQGTQVTVSS

SEQ ID NO: 179 - protein, 119 aa, Artificial Sequence
  Description of Artificial Sequence: Synthetic polypeptide
EVQLVESGGGLVQPGRSLTLSCAASTNIGSISPMGWYRQAPGKQRELVAAIHGQSTLYADSVKGRFTISRDNAKNSIYLQMNSLRPEDTALYYCNKVPWGDYHPQNVYWGQGTQVTVSS

SEQ ID NO: 180 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGKSTLYADSVKGRFTISRDNAKNSIYLQMNSLRPEDTALYYCNKVPWGDYHPRRVYWGQGTQVTVSS

SEQ ID NO: 181-188 - skipped (8 entries)

SEQ ID NO: 189 - protein, 119 aa, Artificial Sequence
  Description of Artificial Sequence: Synthetic polypeptide
EVQLVESGGGLVQPGRSLTLSCAASTNIVSISPMGWYRQAPGKQRELVAAIHGDSTLYADSVKGRFTISRDNAKNSIYLQMNSLRPEDTALYYCNKVPWGDYHPRRVYWGQGTQVTVSS

SEQ ID NO: 190 - protein, 119 aa, Artificial Sequence
  Description of Artificial Sequence: Synthetic polypeptide
EVQLVESGGGLVQPGRSLTLSCAASTNIDSISPMGWYRQAPGKQRELVAAIHGNSTLYADSVKGRFTISRDNAKNSIYLQMNSLRPEDTALYYCNKVPWGDYHPRMVYWGQGTQVTVSS

SEQ ID NO: 191 - protein, 119 aa, Artificial Sequence
  Description of Artificial Sequence: Synthetic polypeptide
EVQLVESGGGLVQPGRSLTLSCAASTNIFMISPMGWYRQAPGKQRELVAAIHGDSTLYADSVKGRFTISRDNAKNSIYLQMNSLRPEDTALYYCNKVPWGRYHPRNVYWGQGTQVTVSS

SEQ ID NO: 192 - protein, 119 aa, Artificial Sequence
  Description of Artificial Sequence: Synthetic polypeptide
EVQLVESGGGLVQPGRSLTLSCAASTNIFRISPMGWYRQAPGKQRELVAAIHGDSTLYADSVKGRFTISRDNAKNSIYLQMNSLRPEDTALYYCNKVPWGRYHPRNVYWGQGTQVTVSS

SEQ ID NO: 193 - protein, 119 aa, Artificial Sequence
  Description of Artificial Sequence: Synthetic polypeptide
EVQLVESGGGLVQPGRSLTLSCAASTNIFSISPMGWYRQAPGKQRELVAAIHGDSTLYADSVKGRFTISRDNAKNSIYLQMNSLRPEDTALYYCNKVPWGEYHPRNVYWGQGTQVTVSS

SEQ ID NO: 194 - protein, 119 aa, Artificial Sequence
  Description of Artificial Sequence: Synthetic polypeptide
EVQLVESGGGLVQPGRSLTLSCAASTNIFSISPMGWYRQAPGKQRELVAAIHGDSTLYADSVKGRFTISRDNAKNSIYLQMNSLRPEDTALYYCNKVPWGKYHPRNVYWGQGTQVTVSS

SEQ ID NO: 195 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGSSTLYADSVKGRFTISRDNAKNSIYLQMNSLRPEDTALYYCNKVPWGRYHPRNVYWGQGTQVTVSS

SEQ ID NO: 196 - protein, 119 aa, Artificial Sequence
  Description of Artificial Sequence: Synthetic polypeptide
EVQLVESGGGLVQPGRSLTLSCAASTNIESISPMGWYRQAPGKQRELVAAIHGNSTLYADSVKGRFTISRDNAKNSIYLQMNSLRPEDTALYYCNKVPWGRYHPRNVYWGQGTQVTVSS

SEQ ID NO: 197 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGFSTLYADSVKGRFTISRDNAKNSIYLQMNSLRPEDTALYYCNKVPWGYYHPRNVYWGQGTQVTVSS

SEQ ID NO: 198 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGHSTLYADSVKGRFTISRDNAKNSIYLQMNSLRPEDTALYYCNKVPWGRYHPRNVYWGQGTQVTVSS

SEQ ID NO: 199 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGFSTVYADSVKGRFTISRDNAKNSIYLQMNSLRPEDTALYYCNKVPWGRYHPRNVYWGQGTQVTVSS

SEQ ID NO: 200 - protein, 119 aa, Artificial Sequence
  Description of Artificial Sequence: Synthetic polypeptide
EVQLVESGGGLVQPGRSLTLSCAASTNIFSIRPMGWYRQAPGKQRELVAAIHGFSTVYADSVKGRFTISRDNAKNSIYLQMNSLRPEDTALYYCNKVPWGDYHPRNVYWGQGTQVTVSS

SEQ ID NO: 201 - protein, 119 aa, Artificial Sequence
  Description of Artificial Sequence: Synthetic polypeptide
EVQLVESGGGLVQPGRSLTLSCAASTNIFSIYPMGWYRQAPGKQRELVAAIHGFSTYYADSVKGRFTISRDNAKNSIYLQMNSLRPEDTALYYCNKVPWGSYHPRNVYWGQGTQVTVSS

SEQ ID NO: 202 - protein, 119 aa, Artificial Sequence
  Description of Artificial Sequence: Synthetic polypeptide
EVQLVESGGGLVQPGRSLTLSCAASTNIFNISPMGWYRQAPGKQRELVAAIHGFSTYYADSVKGRFTISRDNAKNSIYLQMNSLRPEDTALYYCNKVPWGRYHPRNVYWGQGTQVTVSS

SEQ ID NO: 203 - protein, 119 aa, Artificial Sequence
  Description of Artificial Sequence: Synthetic polypeptide
EVQLVESGGGLVQPGRSLTLSCAASTNIFSSSPMGWYRQAPGKQRELVAAIHGFSTWYADSVKGRFTISRDNAKNSIYLQMNSLRPEDTALYYCNKVPWGRYHPRNVYWGQGTQVTVSS

SEQ ID NO: 204 - protein, 119 aa, Artificial Sequence
  Description of Artificial Sequence: Synthetic polypeptide
EVQLVESGGGLVQPGRSLTLSCAASTNISSISPMGWYRQAPGKQRELVAAIHGFDTLYADSVKGRFTISRDNAKNSIYLQMNSLRPEDTALYYCNKVPWGDYHPRNVYWGQGTQVTVSS

SEQ ID NO: 205 - protein, 119 aa, Artificial Sequence
  Description of Artificial Sequence: Synthetic polypeptide
EVQLVESGGGLVQPGRSLTLSCAASTNIFSINPMGWYRQAPGKQRELVAAIHGFDTLYADSVKGRFTISRDNAKNSIYLQMNSLRPEDTALYYCNKVPWGDYHPRNVSWGQGTQVTVSS

SEQ ID NO: 206 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGRSTLYADSVKGRFTISRDNAKNSIYLQMNSLRPEDTALYYCNKVPWGSYHPRNVYWGQGTQVTVSS

SEQ ID NO: 207 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGTSTLYADSVKGRFTISRDNAKNSIYLQMNSLRPEDTALYYCNKVPWGRYHPRNVYWGQGTQVTVSS

SEQ ID NO: 208 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGESTLYADSVKGRFTISRDNAKNSIYLQMNSLRPEDTALYYCNKVPWGRYHPRNVYWGQGTQVTVSS

SEQ ID NO: 209 - protein, 119 aa, Artificial Sequence
  Description of Artificial Sequence: Synthetic polypeptide
EVQLVESGGGLVQPGRSLTLSCAASTNIFSITPMGWYRQAPGKQRELVAAIHGESTLYADSVKGRFTISRDNAKNSIYLQMNSLRPEDTALYYCNKVPWGDYHPRDVYWGQGTQVTVSS

SEQ ID NO: 210 - protein, 119 aa, Artificial Sequence
  Description of Artificial Sequence: Synthetic polypeptide
EVQLVESGGGLVQPGRSLTLSCAASTNIFSTSPYGWYRQAPGKQRELVAAIHGFSTIYADSVKGRFTISRDNAKNSIYLQMNSLRPEDTALYYCNKVPWGDYHPGNVYWGQGTQVTVSS

SEQ ID NO: 211 - protein, 119 aa, Artificial Sequence
  Description of Artificial Sequence: Synthetic polypeptide
EVQLVESGGGLVQPGRSLTLSCAASTNIFSTSPGGWYRQAPGKQRELVAAIHGFSTIYADSVKGRFTISRDNAKNSIYLQMNSLRPEDTALYYCNKVPWGDYHPGNVYWGQGTQVTVSS

SEQ ID NO: 212 - protein, 119 aa, Artificial Sequence
  Description of Artificial Sequence: Synthetic polypeptide
EVQLVESGGGLVQPGRSLTLSCAASTNIFSITPYGWYRQAPGKQRELVAAIHGASTLYADSVKGRFTISRDNAKNSIYLQMNSLRPEDTALYYCNKVPWGDYHPGNVYWGQGTQVTVSS

SEQ ID NO: 213 - protein, 119 aa, Artificial Sequence
  Description of Artificial Sequence: Synthetic polypeptide
EVQLVESGGGLVQPGRSLTLSCAASTNIFSITPGGWYRQAPGKQRELVAAIHGASTLYADSVKGRFTISRDNAKNSIYLQMNSLRPEDTALYYCNKVPWGDYHPGNVYWGQGTQVTVSS

SEQ ID NO: 214 - protein, 119 aa, Artificial Sequence
  Description of Artificial Sequence: Synthetic polypeptide
QVQLVESGGGLVQPGESLRLSCAASTNIFSISPMGWYRQAPGKQRELVAAIHGFSTLYADSVKGRFTISRDNAKNTIYLQMNSLKPEDTAVYYCNKVPWGDYHPRNVYWGQGTQVTVSS

SEQ ID NO: 215 - protein, 110 aa, Artificial Sequence
  Description of Artificial Sequence: Synthetic polypeptide
QVQLVESGGGLVQPGGSLRLSCAASGRTFSVRGMAWYRQAGNNRALVATMNPDGFPNYADAVKGRFTISWDIAENTVYLQMNSLNSEDTTVYYCNSGPYWGQGTQVTVSS

SEQ ID NO: 216 - protein, 123 aa, Artificial Sequence
  Description of Artificial Sequence: Synthetic polypeptide
QVQLVESGGGLVQAGGSLRLSCAASGSIPSIEQMGWYRQAPGKQRELVAALTSGGRANYADSVKGRFTISGDNVRNMVYLQMNSLKPEDTAIYYCSAGRFKGDYAQRSGMDYWGKGTLVTVSS

SEQ ID NO: 217 - protein, 116 aa, Artificial Sequence
  Description of Artificial Sequence: Synthetic polypeptide
QVQLVESGGGLVQAGGSLRLSCAFSGTTYTFDLMSWYRQAPGKQRTVVASISSDGRTSYADSVRGRFTISGENGKNTVYLQMNSLKLEDTAVYYCLGQRSGVRAFWGQGTQVTVSS

SEQ ID NO: 218 - protein, 123 aa, Artificial Sequence
  Description of Artificial Sequence: Synthetic polypeptide
QVQLVESGGGLVQAGGSLRLSCVASGSTSNINNMRWYRQAPGKERELVAVITRGGYAIYLDAVKGRFTISRDNANNAIYLEMNSLKPEDTAVYVCNADRVEGTSGGPQLRDYFGQGTQVTVSS

SEQ ID NO: 219 - protein, 116 aa, Artificial Sequence
  Description of Artificial Sequence: Synthetic polypeptide
QVQLVESGGGLVQAGGSLRLSCAASGSTFGINAMGWYRQAPGKQRELVAVISRGGSTNYADSVKGRFTISRDNAENTVSLQMNTLKPEDTAVYFCNARTYTRHDYWGQGTQVTVSS

SEQ ID NO: 220 - protein, 122 aa, Artificial Sequence
  Description of Artificial Sequence: Synthetic polypeptide
QVRLVESGGGLVQAGGSLRLSCAASISAFRLMSVRWYRQDPSKQREWVATIDQLGRTNYADSVKGRFAISKDSTRNTVYLQMNMLRPEDTAVYYCNAGGGPLGSRWLRGRHWGQGTQVTVSS

SEQ ID NO: 221 - protein, 119 aa, Artificial Sequence
  Description of Artificial Sequence: Synthetic polypeptide
QVRLVESGGGLVQAGESLRLSCAASGRPFSINTMGWYRQAPGKQRELVASISSSGDFTYTDSVKGRFTISRDNAKNTVYLQMNSLKPEDTAVYYCNARRTYLPRRFGSWGQGTQVTVSS

SEQ ID NO: 222 - protein, 117 aa, Artificial Sequence
  Description of Artificial Sequence: Synthetic polypeptide
QVQPVESGGGLVQPGGSLRLSCVVSGSDFTEDAMAWYRQASGKERESVAFVSKDGKRILYLDSVRGRFTISRDIDKKTVYLQMDNLKPEDTGVYYCNSAPGAARNYWGQGTQVTVSS

SEQ ID NO: 223 - protein, 117 aa, Artificial Sequence
  Description of Artificial Sequence: Synthetic polypeptide
QVQPVESGGGLVQPGGSLRLSCVVSGSDFTEDAMAWYRQASGKERESVAFVSKDGKRILYLDSVRGRFTISRDIYKKTVYLQMDNLKPEDTGVYYCNSAPGAARNVWGQGTQVTVSS

SEQ ID NO: 224 - protein, 115 aa, Artificial Sequence [sequence omitted]

SEQ ID NO: 225 - protein, 124 aa, Artificial Sequence
  Description of Artificial Sequence: Synthetic polypeptide
QVQIVESGGGLVQAGGSLRLSCVASGLTYSIVAVGWYRQAPGKEREMVADISPVGNTNYADSVKGRFTISKENAKNTVYLQMNSLKPEDTAVYYCHIVRGWLDERPGPGPIVYWGQGTQVTVSS

SEQ ID NO: 226 - protein, 115 aa, Artificial Sequence
  Description of Artificial Sequence: Synthetic polypeptide
QVQLVESGGGLVQTGGSLRLSCAASGLTFGVYGMEWFRQAPGKQREWVASHTSTGYVYYRDSVKGRFTISRDNAKSTVYLQMNSLKPEDTAIYYCKANRGSYEYWGQGTQVTVSS

SEQ ID NO: 227 - protein, 114 aa, Artificial Sequence
  Description of Artificial Sequence: Synthetic polypeptide
QVQLVESGGGLVQAGGSLRLSCAASTTSSINSMSWYRQAQGKQREPVAVITDRGSTSYADSVKGRFTISRDNAKNTVYLQMNSLKPEDTAIYTCHVIADWRGYWGQGTQVTVSS

SEQ ID NO: 228 - protein, 120 aa, Artificial Sequence
  Description of Artificial Sequence: Synthetic polypeptide
QVQLVESGGGLVQAGGSLRLSCAASGRTLSRYAMGWFRQAPGKERQFVAAISRSGGTTRYSDSVKGRFTISRDNAANTFYLQMNNLRPDDTAVYYCNVRRRGWGRTLEYWGQGTQVTVSS

SEQ ID NO: 229 - protein, 117 aa, Artificial Sequence
  Description of Artificial Sequence: Synthetic polypeptide
QVQLGESGGGLVQAGGSLRLSCAASGSIFSPNAMIWHRQAPGKQREPVASINSSGSTNYGDSVKGRFTVSRDIVKNTMYLQMNSLKPEDTAVYYCSYSDFRRGTQYWGQGTQVTVSS

SEQ ID NO: 230 - protein, 119 aa, Artificial Sequence
  Description of Artificial Sequence: Synthetic polypeptide
QVQLVESGGGLVPSGGSLRLSCAASGATSAITNLGWYRRAPGQVREMVARISVREDKEDYEDSVKGRFTISRDNTQNLVYLQMNNLQPHDTAIYYCGAQRWGRGPGTTWGQGTQVTVSS

SEQ ID NO: 231 - protein, 116 aa, Artificial Sequence
  Description of Artificial Sequence: Synthetic polypeptide
QVQLVESGGGLVQAGGSLRLSCAASGSTFRIRVMRWYRQAPGTERDLVAVISGSSTYYADSVKGRFTISRDNAKNTLYLQMNNLKPEDTAVYYCNADDSGIARDYWGQGTQVTVSS

SEQ ID NO: 232 - protein, 118 aa, Artificial Sequence
  Description of Artificial Sequence: Synthetic polypeptide
QVQLVESGGGLVQAGESRRLSCAVSGDTSKFKAVGWYRQAPGAQRELLAWINNSGVGNTAESVKGRFTISRDNAKNTVYLQMNRLTPEDTDVYYCRFYRRFGINKNYWGQGTQVTVSS

SEQ ID NO: 233 - protein, 122 aa, Artificial Sequence
  Description of Artificial Sequence: Synthetic polypeptide
QVQLVESGGGLVQAGGSLRLSCAASGSTFGNKPMGWYRQAPGKQRELVAVISSDGGSTRYAALVKGRFTISRDNAKNTVYLQMESLVAEDTAVYYCNALRTYYLNDPVVFSWGQGTQVTVSS

SEQ ID NO: 234 - protein, 119 aa, Artificial Sequence
  Description of Artificial Sequence: Synthetic polypeptide
QVQLVESGGGLVQAGGSLRLSCAASGSTSSINTMYWYRQAPGKERELVAFISSGGSTNVRDSVKGRFSVSRDSAKNIVYLQMNSLTPEDTAVYYCNTYIPLRGTLHDYWGQGTQVTVSS

SEQ ID NO: 235 - protein, 115 aa, Artificial Sequence
  Description of Artificial Sequence: Synthetic polypeptide
QVQLVESGGGLVQAGGSLRLSCVASGRTDRITTMGWYRQAPGKQRELVATISNRGTSNYANSVKGRFTISRDNAKNTVYLQMNSLKPEDTAVYYCNARKWGRNYWGQGTQVTVSS

SEQ ID NO: 236 - protein, 119 aa, Artificial Sequence
  Description of Artificial Sequence: Synthetic polypeptide
QVQLVESGGGLVQARGSLRLSCTASGRTIGINDMAWYRQAPGNQRELVATITKGGTTDYADSVDGRFTISRDNAKNTVYLQMNSLKPEDTAVYYCNTKRREWAKDFEYWGQGTQVTVSS

SEQ ID NO: 237 - protein, 114 aa, Artificial Sequence
  Description of Artificial Sequence: Synthetic polypeptide
QVQLVESGGGLVQAGGSLRLSCAASAIGSINSMSWYRQAPGKQREPVAVITDRGSTSYADSVKGRFTISRDNAKNTVYLQMNSLKPEDTAIYTCHVIADWRGYWGQGTQVTVSS

SEQ ID NO: 238 - protein, 119 aa, Artificial Sequence
  Description of Artificial Sequence: Synthetic polypeptide
QVQLVESGGGLVQAGGSLRLSCAASGSTSSINTMYWFRQAPGEERELVATINRGGSTNVRDSVKGRFSVSRDSAKNIVYLQMNRLKPEDTAVYYCNTYIPYGGTLHDFWGQGTQVTVSS

SEQ ID NO: 239 - protein, 114 aa, Artificial Sequence
  Description of Artificial Sequence: Synthetic polypeptide
QVQLVESGGGLVQAGGSLRLSCTTSTTFSINSMSWYRQAPGNQREPVAVITNRGTTSYADSVKGRFTISRDNARNTVYLQMDSLKPEDTAIYTCHVIADWRGYWGQGTQVTVSS

SEQ ID NO: 240 - protein, 116 aa, Artificial Sequence
  Description of Artificial Sequence: Synthetic polypeptide
QVQLVESGGGLVQAGGSLTLSCAASGSTFSIRAMRWYRQAPGTERDLVAVIYGSSTYYADAVKGRFTISRDNAKNTLYLQMNNLKPEDTAVYYCNADTIGTARDYWGQGTQVTVSS

SEQ ID NO: 241 - protein, 117 aa, Artificial Sequence
  Description of Artificial Sequence: Synthetic polypeptide
QVQLVESGGGLVQAGGSLRLSCVASGRTSTIDTMYWHRQAPGNERELVAYVTSRGTSNVADSVKGRFTISRDNAKNTAYLQMNSLKPEDTAVYYCSVRTTSYPVDFWGQGTQVTVSS

SEQ ID NO: 242 - protein, 119 aa, Artificial Sequence
  Description of Artificial Sequence: Synthetic polypeptide
QVQLVESGGGLVQAGGSLRLSCAASGSTSSINTMYWYRQAPGKERELVAFISSGGSTNVRDSVKGRFSVSRDSAKNIVYLQMNSLKPEDTAVYYCNTYIPYGGTLHDFWGQGTQVTVSS

SEQ ID NO: 243 - protein, 111 aa, Artificial Sequence
  Description of Artificial Sequence: Synthetic polypeptide
QVQLVESGGGLVQPGGSLRLSCAASGGDWSANFMYWYRQAPGKQRELVARISGRGVVDYVESVKGRFTISRDNAKNTVYLQMNSLKPEDTAVYYCAVASYWGQGTQVTVSS

SEQ ID NO: 244 - protein, 111 aa, Artificial Sequence
  Description of Artificial Sequence: Synthetic polypeptide
EVQLVESGGGLVQPGGSLRLSCAASGGDWSANFMYWYRQAPGKQRELVARISGRGVVDYVESVKGRFTISRDNSKNTLYLQMNSLRAEDTAVYYCAVASYWGQGTLVTVSS

SEQ ID NO: 245 - protein, 111 aa, Artificial Sequence
  Description of Artificial Sequence: Synthetic polypeptide
EVQLVESGGGLVQPGGSLRLSCAASGGDWSANFMYWVRQAPGKGLEWVSRISGRGVVDYVESVKGRFTISRDNSKNTLYLQMNSLRAEDTAVYYCAVASYWGQGTLVTVSS

SEQ ID NO: 246 - protein, 119 aa, Artificial Sequence
  Description of Artificial Sequence: Synthetic polypeptide
EVQLVESGGGLVQAGGSLRLSCAASGSTSSINTMYWYRQAPGKERELVAFISSGGSTNVRDSVKGRFTISRDNSKNTLYLQMNSLRAEDTAVYYCNTYIPYGGTLHDFWGQGTLVTVSS

SEQ ID NO: 247 - protein, 119 aa, Artificial Sequence
  Description of Artificial Sequence: Synthetic polypeptide
EVQLVESGGGLVQPGGSLRLSCAASGSTSSINTMYWYRQAPGKERELVAFISSGGSTNVRDSVKGRFTISRDNSKNTLYLQMNSLRAEDTAVYYCNTYIPYGGTLHDFWGQGTLVTVSS

SEQ ID NO: 248 - protein, 119 aa, Artificial Sequence
  Description of Artificial Sequence: Synthetic polypeptide
EVQLVESGGGLVQPGGSLRLSCAASGSTSSINTMYWVRQAPGKGLEWVSFISSGGSTNVRDSVKGRFTISRDNSKNTLYLQMNSLRAEDTAVYYCNTYIPYGGTLHDFWGQGTLVTVSS

SEQ ID NO: 249 - protein, 116 aa, Artificial Sequence
  Description of Artificial Sequence: Synthetic polypeptide
QVQLVESGGGVVQAGGSLRLSCAASGSTFSIRAMRWYRQAPGTERDLVAVIYGSSTYYADAVKGRFTISRDNSKNTLYLQMNSLRAEDTAVYYCNADTIGTARDYWGQGTLVTVSS

SEQ ID NO: 250 - protein, 118 aa, Artificial Sequence
  Description of Artificial Sequence: Synthetic polypeptide
QVQLVESGGGVVQPGGSLRLSCAASGSTFSIRAMRWYRQAPGKERELVAVIYGSSTYYADAVKGRFTISRDNSKNTLYLQMNSLRAEDTAVYYCNADTIGTARDYWGQGTLVTVSSGG

SEQ ID NO: 251 - protein, 118 aa, Artificial Sequence
  Description of Artificial Sequence: Synthetic polypeptide
QVQLVESGGGVVQPGGSLRLSCAASGSTFSIRAMRWVRQAPGKGLEWVSVIYGSSTYYADAVKGRFTISRDNSKNTLYLQMNSLRAEDTAVYYCNADTIGTARDYWGQGTLVTVSSGG

SEQ ID NO: 252 - protein, 118 aa, Artificial Sequence
  Description of Artificial Sequence: Synthetic polypeptide
EVQLVESGGGLVQAGGSLRLSCVASGRTSTIDTMYWHRQAPGNERELVAYVTSRGTSNVADSVKGRFTISRDNSKNTLYLQMNSLRAEDTAVYYCSVRTTSYPVDFWGQGTLVTVSGG

SEQ ID NO: 253 - protein, 117 aa, Artificial Sequence
  Description of Artificial Sequence: Synthetic polypeptide
EVQLVESGGGLVQPGGSLRLSCAASGRTSTIDTMYWHRQAPGKERELVAYVTSRGTSNVADSVKGRFTISRDNSKNTLYLQMNSLRAEDTAVYYCSVRTTSYPVDFWGQGTLVTVSS

SEQ ID NO: 254 - protein, 117 aa, Artificial Sequence
  Description of Artificial Sequence: Synthetic polypeptide
EVQLVESGGGLVQPGGSLRLSCAASGRTSTIDTMYWVRQAPGKGLEWVSYVTSRGTSNVADSVKGRFTISRDNSKNTLYLQMNSLRAEDTAVYYCSVRTTSYPVDFWGQGTLVTVSS

SEQ ID NO: 255 - protein, 116 aa, Artificial Sequence
  Description of Artificial Sequence: Synthetic polypeptide
QVQLVESGGGVVQAGGSLTLSCAASGSTFSIRAMRWYRQAPGTERDLVAVIYGSSTYYADAVKGRFTISRDNSKNTLYLQMNSLRAEDTAVYYCNADTIGTARDYWGQGTLVTVSS

SEQ ID NO: 256 - protein, 116 aa, Artificial Sequence; identical to SEQ ID NO: 249
  Description of Artificial Sequence: Synthetic polypeptide

SEQ ID NO: 257 - protein, 116 aa, Artificial Sequence
  Description of Artificial Sequence: Synthetic polypeptide
QVQLVESGGGVVQPGGSLRLSCAASGSTFSIRAMRWYRQAPGKERELVAVIYGSSTYYADAVKGRFTISRDNSKNTLYLQMNSLRAEDTAVYYCNADTIGTARDYWGQGTLVTVSS

SEQ ID NO: 258 - protein, 116 aa, Artificial Sequence
  Description of Artificial Sequence: Synthetic polypeptide
QVQLVESGGGVVQPGGSLRLSCAASGSTFSIRAMRWVRQAPGKGLEWVSVIYGSSTYYADAVKGRFTISRDNSKNTLYLQMNSLRAEDTAVYYCNADTIGTARDYWGQGTLVTVSS

SEQ ID NO: 259 - protein, 12 aa, Artificial Sequence
  Description of Artificial Sequence: Synthetic peptide
GGQDGNEEMGGG

SEQ ID NO: 260 - protein, 10 aa, Artificial Sequence
  Description of Artificial Sequence: Synthetic peptide
GGQDGNEEGG

SEQ ID NO: 261 - protein, 16 aa, Artificial Sequence
  Description of Artificial Sequence: Synthetic peptide
GGGGQDGNEEMGGGGG

SEQ ID NO: 262 - protein, 7 aa, Artificial Sequence
  Description of Artificial Sequence: Synthetic peptide
APFGSEM

SEQ ID NO: 263 - protein, 7 aa, Artificial Sequence
  Description of Artificial Sequence: Synthetic peptide
AWNGPYE

SEQ ID NO: 264 - protein, 10 aa, Artificial Sequence
  Description of Artificial Sequence: Synthetic peptide
AQDNGDTKTG

SEQ ID NO: 265 - protein, 8 aa, Artificial Sequence
  Description of Artificial Sequence: Synthetic peptide
AEAKETQG

SEQ ID NO: 266 - protein, 9 aa, Artificial Sequence
  Description of Artificial Sequence: Synthetic peptide
ATRREQVEG

SEQ ID NO: 267 - protein, 7 aa, Artificial Sequence
  Description of Artificial Sequence: Synthetic peptide
AQAPSQP

SEQ ID NO: 268 - protein, 10 aa, Artificial Sequence
  Description of Artificial Sequence: Synthetic peptide
ATRSRTRNDG

SEQ ID NO: 269 - protein, 10 aa, Artificial Sequence
  Description of Artificial Sequence: Synthetic peptide
ADVDAPDGLG

SEQ ID NO: 270 - protein, 9 aa, Artificial Sequence
  Description of Artificial Sequence: Synthetic peptide
AADISDPGG

SEQ ID NO: 271 - protein, 8 aa, Artificial Sequence
  Description of Artificial Sequence: Synthetic peptide
ALSVDPSG

SEQ ID NO: 272 - protein, 8 aa, Artificial Sequence
  Description of Artificial Sequence: Synthetic peptide
ARLSVDPG

SEQ ID NO: 273 - protein, 8 aa, Artificial Sequence
  Description of Artificial Sequence: Synthetic peptide
AVEAADRG

SEQ ID NO: 274 - protein, 12 aa, Artificial Sequence
  Description of Artificial Sequence: Synthetic peptide
GGPDGNEEMGGG

SEQ ID NO: 275 - protein, 12 aa, Artificial Sequence
  Description of Artificial Sequence: Synthetic peptide
GGFDGNEEMGGG

SEQ ID NO: 276 - protein, 12 aa, Artificial Sequence
  Description of Artificial Sequence: Synthetic peptide
GGGDGNEEMGGG

SEQ ID NO: 277 - protein, 12 aa, Artificial Sequence
  Description of Artificial Sequence: Synthetic peptide
GGEMDGEGQNGG

SEQ ID NO: 278 - protein, 14 aa, Artificial Sequence
  Description of Artificial Sequence: Synthetic peptide
GGGGGPDGNEEPGG

SEQ ID NO: 279 - protein, 14 aa, Artificial Sequence
  Description of Artificial Sequence: Synthetic peptide
GGGGSLDGNEEPGG

SEQ ID NO: 280 - protein, 14 aa, Artificial Sequence
  Description of Artificial Sequence: Synthetic peptide
GGGGALDGNEEPGG

SEQ ID NO: 281 - protein, 14 aa, Artificial Sequence
  Description of Artificial Sequence: Synthetic peptide
GGGGGLDGNEEPGG

SEQ ID NO: 282 - protein, 13 aa, Artificial Sequence
  Description of Artificial Sequence: Synthetic peptide
GGGALDGNEEPGG

SEQ ID NO: 283 - protein, 15 aa, Artificial Sequence
  Description of Artificial Sequence: Synthetic peptide
GGGGGPDGNEEPGGG

SEQ ID NO: 284 - protein, 14 aa, Artificial Sequence
  Description of Artificial Sequence: Synthetic peptide
GGSGALDGNEEPGG

SEQ ID NO: 285 - protein, 14 aa, Artificial Sequence
  Description of Artificial Sequence: Synthetic peptide
GGSGSLDGNEEPGG

SEQ ID NO: 286 - protein, 14 aa, Artificial Sequence
  Description of Artificial Sequence: Synthetic peptide
GGSGGPDGNEEPGG

SEQ ID NO: 287 - protein, 15 aa, Artificial Sequence
  Description of Artificial Sequence: Synthetic peptide
GGVRDGPDGNEEPGG

SEQ ID NO: 288 - protein, 16 aa, Artificial Sequence
  Description of Artificial Sequence: Synthetic peptide
GGSGGPDGNEEPGGGG

SEQ ID NO: 289 - protein, 14 aa, Artificial Sequence
  Description of Artificial Sequence: Synthetic peptide
GGGRGPDGNEEPGG

SEQ ID NO: 290 - protein, 14 aa, Artificial Sequence
  Description of Artificial Sequence: Synthetic peptide
GGSGGLDGNEEPGG

SEQ ID NO: 291 - protein, 14 aa, Artificial Sequence
  Description of Artificial Sequence: Synthetic peptide
GGGVGPDGNEEPGG

SEQ ID NO: 292 - protein, 14 aa, Artificial Sequence
  Description of Artificial Sequence: Synthetic peptide
GGGEGPDGNEEPGG

SEQ ID NO: 293 - protein, 14 aa, Artificial Sequence
  Description of Artificial Sequence: Synthetic peptide
GGGVALDGNEEPGG

SEQ ID NO: 294 - protein, 14 aa, Artificial Sequence
  Description of Artificial Sequence: Synthetic peptide
GGGRALDGNEEPGG

SEQ ID NO: 295 - protein, 14 aa, Artificial Sequence
  Description of Artificial Sequence: Synthetic peptide
GGYAGLDGNEEPGG

SEQ ID NO: 296 - protein, 14 aa, Artificial Sequence
  Description of Artificial Sequence: Synthetic peptide
GGAGGPDGNEEPGG

SEQ ID NO: 297 - protein, 14 aa, Artificial Sequence
  Description of Artificial Sequence: Synthetic peptide
GGRGGPDGNEEPGG

SEQ ID NO: 298 - protein, 15 aa, Artificial Sequence
  Description of Artificial Sequence: Synthetic peptide
GGGGPDGNEEPGGGG

SEQ ID NO: 299 - protein, 14 aa, Artificial Sequence
  Description of Artificial Sequence: Synthetic peptide
GGGEALDGNEEPGG

SEQ ID NO: 300 - protein, 14 aa, Artificial Sequence
  Description of Artificial Sequence: Synthetic peptide
GGDASLDGNEEPGG

SEQ ID NO: 301 - protein, 13 aa, Artificial Sequence
  Description of Artificial Sequence: Synthetic peptide
GGRDAPDGNEEGG

SEQ ID NO: 302 - protein, 10 aa, Artificial Sequence
  Description of Artificial Sequence: Synthetic peptide
SGGGGSGGVV

SEQ ID NO: 303 - protein, 16 aa, Artificial Sequence
  Description of Artificial Sequence: Synthetic peptide
SGGGGSGGGGSGGGGS

SEQ ID NO: 304 - protein, 17 aa, Artificial Sequence
  Description of Artificial Sequence: Synthetic peptide
SGGGGSGGGGSGGGGGS

SEQ ID NO: 305 - protein, 10 aa, Artificial Sequence
  Description of Artificial Sequence: Synthetic peptide
SGGGGSGGGS

SEQ ID NO: 306 - protein, 115 aa, Artificial Sequence
  Description of Artificial Sequence: Synthetic polypeptide
QVQLQESGGGLVQAGGSLRLSCAASGSIFSIASMGWYRQAPGKQRELVAVITSFSSTNYADSVKGRFTISRDNAKNTVYLQMNSLKPEDTGVYYCNARYFERTDWGQGTQVTVSS

SEQ ID NO: 307 - protein, 115 aa, Artificial Sequence
  Description of Artificial Sequence: Synthetic polypeptide
QVQLQESGGGLVQAGGSLRLSCAAPGSIFSIASMGWYRQAPGKQRELVAVITSFSSTNYADSVKGRFTISRDNAKNTVYLQMNSLKPEDTGVYYCNARYFERTDWGQGTQVTVSS

SEQ ID NO: 308 - protein, 115 aa, Artificial Sequence
  Description of Artificial Sequence: Synthetic polypeptide
QVQLQESGGGLVQAGGSLRLSCAASGSIFSIASMAWYRQAPGKQRELVAAITSFSSTNYADSVKGRFTISRDNAKNTVYLQMNSLKPEDTGVYYCNARYFERTDWGQGTQVTVSS

SEQ ID NO: 309 - protein, 115 aa, Artificial Sequence
  Description of Artificial Sequence: Synthetic polypeptide
QVQLQESGGGLVQAGGSLRLSCAASESIFSINVMAWHRQAPGKQRELVARITSGGSTNYADSVKGRFTISRDNAKNTVYLQMNSLKPEDTGVYYCGAYQGLYAYWGQGTQVTVSS

SEQ ID NO: 310 - protein, 115 aa, Artificial Sequence
  Description of Artificial Sequence: Synthetic polypeptide
QVQLQESGGGLVQAGGSLRLSCVASGSSFSITSMAWYRQAPGKQRDLVAAITSFGSTNYADSVKDRFTISRDNAKNTVYLQMNSLKPEDTAVYYCNGRVFDHVYWGQGTQVTVSS

SEQ ID NO: 311 - protein, 115 aa, Artificial Sequence
  Description of Artificial Sequence: Synthetic polypeptide
QVQLQESGGGLVQAGGSLKLSCAASSSIFSISSMSWYRQAPGKQRELVAAITTFDYTNYADSVKGRFTISRDNAKNMMYLQMNSLKPEDTAVYLCNARAFGRDYWGQGTQVTVSS

SEQ ID NO: 312 - protein, 115 aa, Artificial Sequence
  Description of Artificial Sequence: Synthetic polypeptide
QVQLQESGGGLVQAGGSLKLSCAASSSIFSISSMSWYRQAPGKQRELVAAITSFGSTNYADSVKGRFTISRDNAKNMMYLQMNSLKPEDTAVYRCNARTMGRDYWGQGTQVTVSS

SEQ ID NO: 313 - protein, 116 aa, Artificial Sequence
  Description of Artificial Sequence: Synthetic polypeptide
QVQLQESGGGLVQPGGSLRLSCAASGSTLNIKIMAWHRQAPGKQRELVATLTSGGNTNYADSVKGRFTISRDNAKNTVYLQMNSLQPEDTAVYYCGLWDGVGGAYWGRGTQVTVSS

SEQ ID NO: 314 - protein, 116 aa, Artificial Sequence
  Description of Artificial Sequence: Synthetic polypeptide
QVQLQESGGGLVQPGGSLRISCAASGSTLNIKIMAWHRQAPGKQRELVATLTSGGNTNYADSVKGRFTISRDNAKNTVYLQMNSLQPEDTAVYYCGLWDGVGGAYWGRGTQVTVSS

SEQ ID NO: 315 - protein, 116 aa, Artificial Sequence
  Description of Artificial Sequence: Synthetic polypeptide
QVQLQESGGGLVQAGGSLRLSCAASGSTFNIKTMAWHRQAPGNQRELVATLTSGGNTNYADSVKGRFTISRDNAKNTVYLQMNSLKPEDTAVYYCGLWNGVGGAYWGRGTQVTVSS

SEQ ID NO: 316 - protein, 115 aa, Artificial Sequence
  Description of Artificial Sequence: Synthetic polypeptide
QVQLQDGGGLVQPGGSLRLSCAASGSTFNIKLMAWHRQAPGNQRELVATLTSGGNTNYADSVKGRFTISRDNASNIVYLQMNSLKPEDTAVYYCGLWDGVGGAYWGRGTQVTVSS

SEQ ID NO: 317 - protein, 116 aa, Artificial Sequence
  Description of Artificial Sequence: Synthetic polypeptide
QVQLQESGGGLVQAGGSLRLSCAASGSTFNFKIMAWHRQAPGKQRELVASLTSEGLTNYRDSVKGRFTISRDNAKNTVYLQMNNLKPEDTAVYYCGLWDGVGGAYWGRGTQVTVSS

SEQ ID NO: 318 - protein, 114 aa, Artificial Sequence
  Description of Artificial Sequence: Synthetic polypeptide
QVQLQESGGGLVQPGGSLRLSCAASGFMFSSYSMSWYRQAPGKQRELVAAITTWGSTNYADSVKGRFTISRDNAKNTVWLQMNSLEPEDTAVYFCNARSWNNYWGQGTQVTVSS

SEQ ID NO: 319 - protein, 114 aa, Artificial Sequence
  Description of Artificial Sequence: Synthetic polypeptide
QVQLQESGGGLVQVGGSLRLSCAASGFMFSSYSMSWYRQAPGKQRELVAAITSYGSTNYADSVKGRFTISRDNAKNTVWLQMNSLKPEDTAVYFCNARSWNNYWGQGTQVTVSS

SEQ ID NO: 320 - protein, 114 aa, Artificial Sequence
  Description of Artificial Sequence: Synthetic polypeptide
QVQLQESGGGLVQPGGSLRLSCAASGFTFSSHSMSWYRQAPGKQRELVAAITTYGSTNYIDSVKGRFTISRDNTKNTVYLQMNSLKPEDTAVYFCNARSWNNYWGQGTQVTVSS

SEQ ID NO: 321 - protein, 117 aa, Artificial Sequence
  Description of Artificial Sequence: Synthetic polypeptide
QVQLQESGGGLVQAGGSLRLSCVASGSSFSHNTMGWYRQAPGKQRDLVARITTFGTTNYADSVKGRFTISRDNAKNTVYLQMNSLKPEDTAVYYCNGESFGRIWYNWGQGTQVTVSS

SEQ ID NO: 322 - protein, 116 aa, Artificial Sequence
  Description of Artificial Sequence: Synthetic polypeptide
QVQLQESGGGLVQAGASLRLTCTASGGRFSYATMGWSRQAPGKQREMVARITSSGFSTNYADSVKGRFTISRDNAKNAVYLQMDSLKPEDTAVYYCNAQHFGTDSWGQGTQVTVSS

SEQ ID NO: 323 - protein, 116 aa, Artificial Sequence
  Description of Artificial Sequence: Synthetic polypeptide
QVQLQESGGGLVQAGASLRLTCTASGSRFSYATMGWSRQAPGKQRELVARITSSGFSTNYADSVKGRFTISRDNAKNAVYLQMDSLKPEDTAVYYCNAQQFGTDSWGQGTQVTVSS

SEQ ID NO: 324 - protein, 117 aa, Artificial Sequence
  Description of Artificial Sequence: Synthetic polypeptide
QVQLQESGGGLVQAGGSLRLSCAASGSTFTSNVMGWHRQAPGKQRELVANMHSGGSTNYADSVKGRFTISRDNAKNIVYLQMNNLKIEDTAVYYCRWYGIQRAEGYWGQGTQVTVSS

SEQ ID NO: 325 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISVDGSTNYADSVKGRFTVSRDNAKNTVYLQMNSLQPEDTAVYYCYAYRWVGRDTYWGQGTQVTVSS

SEQ ID NO: 326 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISVDGSTNYADSVKGRFTISRDNAKNTVYLQMNSLQPEDTAVYYCYAYRWVGRDTYWGQGTQVTVSS

SEQ ID NO: 327 - protein, 117 aa, Artificial Sequence
  Description of Artificial Sequence: Synthetic polypeptide
QVQLQESGGGLVVSGGSLRLSCAASGSSVSFLSMAWYRQAPGKKRELVAGISVDGSTNYADSVKGRFTISRDNAKNTVYLQMNSLQPEDTAAYYCYAYRWVGRDTYWGQGTQVTVSS

SEQ ID NO: 328 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISVDGSTNYADSVKGRFTISRDNAENTVYLQMNSLQPEDTAVYYCYAYRWEGRDTYWGQGTQVTVSS

SEQ ID NO: 329 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISVDGSTNYADSVKGRFTISRDNAENTVYLQMNSLQPEDTAVYYCYAYRWEGRNTYWGQGTQVTVSS

SEQ ID NO: 330 - protein, 117 aa, Artificial Sequence
  Description of Artificial Sequence: Synthetic polypeptide
QVQLQESGGGLVQPGGSLRLSCAASGSSVSFLSMAWYRQAPGKKRELVAGISTDGSTNYVDSVKGRFTISRDNAKNTVYLQMNSLQPEDTAVYYCYAYRWVGRYTYWGQGTQVTVSS

SEQ ID NO: 331 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISTDGTTNYVDSVKDRFTISRDNAKNTVYLQMNSLQPEDTAAYYCYAYRWVGRDTYWGQGTQVTVSS

SEQ ID NO: 332 - protein, 117 aa, Artificial Sequence
  Description of Artificial Sequence: Synthetic polypeptide
QVQLQESGGGLVVAGGSLRLSCAASGSSVSFLSIAWYRQAPGKKRELVAGISTDGTTNYVDSVKDRFTISRDNAKNTVYLQMNSLQPEDTAAYYCYAYRWVGRDTYWGQGTQVTVSS

SEQ ID NO: 333 - protein, 117 aa, Artificial Sequence
  Description of Artificial Sequence: Synthetic polypeptide
QVQLQESGGGLVQAGGSLTLSCAASGSSVSFLSMAWYRQAPGKKRELVAGISTDGTTNYVDSVKDRFTISRDNAKNTVYLQMNSLQPEDTAAYYCYAYRWVGRDTYWGQGTQVTVSS

SEQ ID NO: 334 - protein, 117 aa, Artificial Sequence
  Description of Artificial Sequence: Synthetic polypeptide
QVQLQESGGGLVQAGGSLRLSCAASGSSVSFLSMAWYRQAPGKKRELVAGISTDGSTNYADSVKGRFTISEGNAKNTVDLQMNSLQPEDTAVYYCYAYRWVDRYTYWGQGTQVTVSS

SEQ ID NO: 335 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISTDGSTNYADSVKGRFTISEDNAKNTVDLQMNSLQPEDTAVYYCYAYRWIDRYTYWGQGTQVTVSS

SEQ ID NO: 336 - protein, 117 aa, Artificial Sequence
  Description of Artificial Sequence: Synthetic polypeptide
QVQLQESGGGLVQPGGSLRLSCAASGSSVSFLSMAWYRQAPGKKRELVAGISTDGSTNYADSVKGRFTISEDNAKNTVDLQMNSLQPEDTAVYYCYAYRWVDRYTYWGQGTQVTVSS

SEQ ID NO: 337 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISSDGSTNYVDSVKGRFTISRDNAKNIVFLQMNSLQPQDTAVYYCYAYRWVGRDTYWGQGTQVTVSS

SEQ ID NO: 338 - protein, 117 aa, Artificial Sequence
  Description of Artificial Sequence: Synthetic polypeptide
QVQLQESGGGLVVAGGSLRLSCAASGSSVSFLSMAWYRQAPGKKRELVAGISADGSTDYIDSVKGRFTISRDSANNTMYLQMNSLQPEDTAVYYCYAYRWTTRYTYWGQGTQVTVSS

SEQ ID NO: 339 - protein, 117 aa, Artificial Sequence
  Description of Artificial Sequence: Synthetic polypeptide
QVQLQESGGGLVQPGGSLRLSCAASGFTLDYYAIGWYRQAPGKKRELVAGISSDGSTHYVDSVKGRFAISRDNAENTVYLQMNDLQPDDTAVYYCYAYRWVGGYTYWGQGTQVTVSS

SEQ ID NO: 340 - protein, 119 aa, Artificial Sequence
  Description of Artificial Sequence: Synthetic polypeptide
QVQLQESGGGLVQAGGSLRLSCVASGSTSSINAMGWYRRAPGKQRELVAGISSDGSKNYADSVKGRFTISRDNAKNTVYLQMNSLKPEDTAVYYCYYFRTVAASSMQYWGQGTQVTVSS

SEQ ID NO: 341 - protein, 119 aa, Artificial Sequence
  Description of Artificial Sequence: Synthetic polypeptide
QVQLQESGGGLVQAGGSLRLSCVASGSTSSINAMGWYRRAPGKQRELVAGISSDGSKVYADSVKGRFTISRDNAKNTVYLQMNSLKPEDTAVFYCYYFRTVSGSSMRYWGQGTQVTVSS

SEQ ID NO: 342 - protein, 118 aa, Artificial Sequence
  Description of Artificial Sequence: Synthetic polypeptide
QVQLQESGGGLVQAGGSLRLSCAASGITSSVYSMGWYRQAPGKQRELVAGSSSDGSTHYVDSVRGRFTISRDNAKNTVYLQMSSLKPEDTAVYYCYANRGFAGAPSYWGQGTQVTVSS

SEQ ID NO: 343 - protein, 114 aa, Artificial Sequence
  Description of Artificial Sequence: Synthetic polypeptide
QVQLQESGGGLVQAGGSLRLSCAASGRTSMFNSMGWHRQAPGKQRELVAIIRSGGSSNYADTVKGRFTISRDNTKNTVYLQMNDLKPEDTAVYYCFYYFQSSYWGQGTQVTVSS

SEQ ID NO: 344 - protein, 114 aa, Artificial Sequence
  Description of Artificial Sequence: Synthetic polypeptide
QVQLQESGGGLVQAGGSLRLSCAASGRTSMVNSMGWHRQAPGKQRELVALITSGGSSNYADTVKGRFTISRDNTKNTVYLQMNDLKPEDTAVYYCFYYFQSSYWGQGTQVTVSS

SEQ ID NO: 345 - protein, 119 aa, Artificial Sequence
  Description of Artificial Sequence: Synthetic polypeptide
QVQLQESGGGLVQAGGSLRLSCTASGSIFSIAVMGWYRQVPGKRREWVATIFDGSYTNYADSVKGRFTISRDNARNKVYLQMNNLKPEDTAVYYCQTHWTQGSVPKESWGQGTQVTVSS

SEQ ID NO: 346 - protein, 115 aa, Artificial Sequence
  Description of Artificial Sequence: Synthetic polypeptide
QVQLQESGGGLVQAGGSLRLSCVASSGIFSDMSMVWYRQAPGKQRELVASITTFGSTNYADPVKGRFTISRDNAKNTVYLQMNSLKPEDTAVYYCSGRSYSSDYWGRGTQVTVSS

SEQ ID NO: 347 - protein, 115 aa, Artificial Sequence
  Description of Artificial Sequence: Synthetic polypeptide
QVQLQESGGGLVQAGGSLRLSCVASGSISSIIVMGWSRQAPGKQRESVATITRDGTRNYADSLKGRFTISRDNAKNTSYLQINSLKPEDTAVYSCYARYGDINYWGKGTQVTVSS

SEQ ID NO: 348 - protein, 115 aa, Artificial Sequence
  Description of Artificial Sequence: Synthetic polypeptide
QVQLQESGGGLVQAGGSLRLSCVASGSISSIIVMGWSRQAPGKQRESLATISRGGTRTYADSVKGRFTISRDNAKNTSYLQMNSLKPEDTAVYSCYARYGDINYWGKGTQVTVSS

SEQ ID NO: 349 - protein, 114 aa, Artificial Sequence
  Description of Artificial Sequence: Synthetic polypeptide
QVQLQESGGGLVQAGGSLRLSCVASGSIFTTNSMGWHRQGPGKQRELVALIGSAGSTKYADSVKGRFTISRDNAKNTVSLQMDSLKPEDTAVYYCFYYDSRSYWGQGTQVTVSS

SEQ ID NO: 350 - protein, 114 aa, Artificial Sequence
  Description of Artificial Sequence: Synthetic polypeptide
QVQLQESGGGMVQPGGSLRLSCAASGSREISTMGWHRQAPGKQRELAARITSGGITKYADSVKGRFTISRDNAKKTVYLQMNSLKSEDTAVYYCFAYDNINAYWGQGTQVTVSS

SEQ ID NO: 351 - protein, 114 aa, Artificial Sequence
  Description of Artificial Sequence: Synthetic polypeptide
QVQLQESGGGWVQAGGSLRLSCAASGSREISTMGWHRQAPGKQRELAARITSGGITKYADSVKGRFTISRDNAKKTVYLQMNSLKSEDTAVYYCFAYDNINAYWGQGTQVTVSS

SEQ ID NO: 352 - protein, 114 aa, Artificial Sequence
  Description of Artificial Sequence: Synthetic polypeptide
QVQLQESGGGWVQAGGSLRLSCTASGSREISTMGWHRQAPGKQRELAARITSGGITKYADSVKGRFTISRDNAKKTVYLQMDSLKSEDTAVYYCFAYDNINAYWGQGTQVTVSS

SEQ ID NO: 353 - protein, 114 aa, Artificial Sequence
  Description of Artificial Sequence: Synthetic polypeptide
QVQLQESGGGSVQAGRSLGLSCAASGSREISTMGWHRQAPGKQRELAARITSGGITKYADSVKGRFTISRDNAKKTVYLQMNSLKSEDTAVYYCFAYDNINAYWGQGTQVTVSS

SEQ ID NO: 354 - protein, 115 aa, Artificial Sequence
  Description of Artificial Sequence: Synthetic polypeptide
QVQLQESGGGLVQAGGSLRLSCTASGSIFRGAAMYWHRQAPGKQRELVAAITTSGNTSYADSVKGRFTISRDNAKNTMYLQIISLKPEDTAVYYCAFWIAGKAYWGQGTQVTVSS

SEQ ID NO: 355 - protein, 115 aa, Artificial Sequence
  Description of Artificial Sequence: Synthetic polypeptide
QVQLQESGGGLVQPGGSLRLSCAASGSISSFNFMSWHRQAPGKERELAGVITRGGATNYADSVKGRFTISRDNVKNTVYLQMNGLKPEDTAVYYCHGRSQLGSTWGQGTQVTVSS

SEQ ID NO: 356 - protein, 116 aa, Artificial Sequence
  Description of Artificial Sequence: Synthetic polypeptide
QVQLQESGGGLVQAGGSLRLSCLASGTIFTASTMGWHRQPPGKQRELVASIAGDGRTNYAESTEGRFTISRDDAKNTMYLQMNSLKPEDTAVYYCYAYYLDTYAYWGQGTQVTVSS

SEQ ID NO: 357 - protein, 115 aa, Artificial Sequence
  Description of Artificial Sequence: Synthetic polypeptide
EVQLVESGGGLVQPGGSLTLSCAASGSIFSIASMGWYRQAPGKQRELVAVITSFSSTNYADSVKGRFTISRDNAKNSVYLQMNSLRAEDTAVYYCNARYFERTDWGQGTLVTVSS

SEQ ID NO: 358 - protein, 114 aa, Artificial Sequence
  Description of Artificial Sequence: Synthetic polypeptide
EVQLVESGGGLVQPGGSLTLSCAASGRTSMFNSMGWHRQAPGKQRELVAIIRSGGSSNYADTVKGRFTISRDNAKNSVYLQMNSLRAEDTAVYYCFYYFQSSYWGQGTLVTVSS

SEQ ID NO: 359 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISVDGSTNYADSVKGRFTISRDNAKNSVYLQMNSLRAEDTAVYYCYAYRWVGRDTYWGQGTLVTVSS

SEQ ID NO: 360 - protein, 115 aa, Artificial Sequence
  Description of Artificial Sequence: Synthetic polypeptide
EVQLVESGGGLVQPGGSLTLSCTASGSIFRGAAMYWHRQAPGKQRELVAAITTSGNTSYADSVKGRFTISRDNAKNSMYLQMNSLRAEDTAVYYCAFWIAGKAYWGQGTLVTVSS

SEQ ID NO: 361 - protein, 116 aa, Artificial Sequence
  Description of Artificial Sequence: Synthetic polypeptide
EVQLVESGGGLVQPGGSLTLSCAASGSTFNIKTMAWHRQAPGNQRELVATLTSGGNTNYADSVKGRFTISRDNAKNSVYLQMNSLRAEDTAVYYCGLWNGVGGAYWGQGTLVTVSS

SEQ ID NO: 362 - protein, 116 aa, Artificial Sequence
  Description of Artificial Sequence: Synthetic polypeptide
EVQLVESGGGLVQPGGSLTLSCAASGSTLNIKIMAWHRQAPGKQRELVATLTSGGNTNYADSVKGRFTISRDNAKNSVYLQMNSLRAEDTAVYYCGLWDGVGGAYWGQGTLVTVSS

SEQ ID NO: 363 - protein, 115 aa, Artificial Sequence
  Description of Artificial Sequence: Synthetic polypeptide
EVQLVESGGGLVQPGGSLTLSCAASSSIFSISSMSWYRQAPGKQRELVAAITTFDYTNYADSVKGRFTISRDNAKNSMYLQMNSLRAEDTAVYYCNARAFGRDYWGQGTLVTVSS

SEQ ID NO: 364 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKNYADSVKGRFTISRDNAKNSVYLQMNSLRAEDTAVYYCYYFRTVAASSMQYWGQGTLVTVSS

SEQ ID NO: 365 - protein, 114 aa, Artificial Sequence
  Description of Artificial Sequence: Synthetic polypeptide
EVQLVESGGGLVQPGGSLTLSCAASGFMFSSYSMSWYRQAPGKQRELVAAITSYGSTNYADSVKGRFTISRDNAKNSVYLQMNSLRAEDTAVYYCNARSWNNYWGQGTLVTVSS

SEQ ID NO: 366 - protein, 114 aa, Artificial Sequence
  Description of Artificial Sequence: Synthetic polypeptide
EVQLVESGGGLVQPGGSLTLSCAASGSVSMFNSMGWHRQPPGKQRELVAIITSGGSSNYADTVKGRFTISRDNAKNSVYLQMNSLRAEDTAVYYCFYYFQSSYWGQGTLVTVSS

SEQ ID NO: 367 - protein, 116 aa, Artificial Sequence
  Description of Artificial Sequence: Synthetic polypeptide
EVQLVESGGGLVQPGGSLTLSCTASGGRFSYATMGWSRQAPGKQREMVARITSSGFSTNYADSVKGRFTISRDNAKNSVYLQMNSLRAEDTAVYYCNAQHFGTDSWGQGTLVTVSS

SEQ ID NO: 368 - protein, 115 aa, Artificial Sequence
  Description of Artificial Sequence: Synthetic polypeptide
EVQLVESGGGLVQPGGSLTLSCAASGSISSFNFMSWHRQAPGKERELAGVITRGGATNYADSVKGRFTISRDNAKNSVYLQMNSLRAEDTAVYYCHGRSQLGSTWGQGTLVTVSS

SEQ ID NO: 369 - protein, 115 aa, Artificial Sequence
  Description of Artificial Sequence: Synthetic polypeptide
EVQLVESGGGLVQPGGSLTLSCAASESIFSINVMAWHRQAPGKQRELVARITSGGSTNYADSVKGRFTISRDNAKNSVYLQMNSLRAEDTAVYYCGAYQGLYAYWGQGTLVTVSS

SEQ ID NO: 370 - protein, 114 aa, Artificial Sequence
  Description of Artificial Sequence: Synthetic polypeptide
EVQLVESGGGLVQPGGSLTLSCAASGSREISTMGWHRQAPGKQRELAARITSGGITKYADSVKGRFTISRDNAKNSVYLQMNSLRAEDTAVYYCFAYDNINAYWGQGTLVTVSS

SEQ ID NO: 371 - protein, 119 aa, Artificial Sequence
  Description of Artificial Sequence: Synthetic polypeptide
EVQLVESGGGLVQPGGSLTLSCTASGSIFSIAVMGWYRQVPGKRREWVATIFDGSYTNYADSVKGRFTISRDNAKNSVYLQMNSLRAEDTAVYYCQTHWTQGSVPKESWGQGTLVTVSS

SEQ ID NO: 372 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYADSVKGRFTISRDNAKNSVYLQMNSLRAEDTAVYYCYYFRTVSGSSMRYWGQGTLVTVSS

SEQ ID NO: 373 - protein, 115 aa, Artificial Sequence
  Description of Artificial Sequence: Synthetic polypeptide
EVQLVESGGGLVQPGGSLTLSCVASSGIFSDMSMVWYRQAPGKQRELVASITTFGSTNYADPVKGRFTISRDNAKNSVYLQMNSLRAEDTAVYYCSGRSYSSDYWGQGTLVTVSS

SEQ ID NO: 374 - protein, 114 aa, Artificial Sequence
  Description of Artificial Sequence: Synthetic polypeptide
EVQLVESGGGLVQPGGSLTLSCAASGFMFSSYSMSWYRQAPGKQRELVAAITTWGSTNYADSVKGRFTISRDNAKNSVYLQMNSLRAEDTAVYYCNARSWNNYWGQGTLVTVSS

SEQ ID NO: 375 - protein, 116 aa, Artificial Sequence
  Description of Artificial Sequence: Synthetic polypeptide
EVQLVESGGGLVQPGGSLTLSCTASGSRFSYATMGWSRQAPGKQRELVARITSSGFSTNYADSVKGRFTISRDNAKNSVYLQMNSLRAEDTAVYYCNAQQFGTDSWGQGTLVTVSS

SEQ ID NO: 376 - protein, 117 aa, Artificial Sequence
  Description of Artificial Sequence: Synthetic polypeptide
EVQLVESGGGLVQPGGSLTLSCAASGSTFTSNVMGWHRQAPGKQRELVANMHSGGSTNYADSVKGRFTISRDNAKNSVYLQMNSLRAEDTAVYYCRWYGIQRAEGYWGQGTLVTVSS

SEQ ID NO: 377 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISTDGSTNYVDSVKGRFTISRDNAKNSVYLQMNSLRAEDTAVYYCYAYRWVGRYTYWGQGTLVTVSS

SEQ ID NO: 378 - protein, 115 aa, Artificial Sequence
  Description of Artificial Sequence: Synthetic polypeptide
EVQLVESGGGLVQPGGSLTLSCVASGSISSIIVMGWSRQAPGKQRESVATITRDGTRNYADSLKGRFTISRDNAKNSSYLQMNSLRAEDTAVYYCYARYGDINYWGQGTLVTVSS

SEQ ID NO: 379 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTDYIDSVKGRFTISRDNAKNSVYLQMNSLRAEDTAVYYCYAYRWTTRYTYWGQGTLVTVSS

SEQ ID NO: 380 - protein, 116 aa, Artificial Sequence
  Description of Artificial Sequence: Synthetic polypeptide
EVQLVESGGGLVQPGGSLTLSCLASGTIFTASTMGWHRQPPGKQRELVASIAGDGRTNYAESTEGRFTISRDNAKNSMYLQMNSLRAEDTAVYYCYAYYLDTYAYWGQGTLVTVSS

SEQ ID NO: 381 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISVDGSTNYADSVKGRFTISRDNAKNSVYLQMNSLRAEDTAVYYCYAYRWEGRNTYWGQGTLVTVSS

SEQ ID NO: 382 - protein, 117 aa, Artificial Sequence
  Description of Artificial Sequence: Synthetic polypeptide
EVQLVESGGGLVQPGGSLTLSCVASGSSFSHNTMGWYRQAPGKQRDLVARITTFGTTNYADSVKGRFTISRDNAKNSVYLQMNSLRAEDTAVYYCNGESFGRIWYNWGQGTLVTVSS

SEQ ID NO: 383 - protein, 115 aa, Artificial Sequence
  Description of Artificial Sequence: Synthetic polypeptide
EVQLVESGGGLVQPGGSLTLSCVASGSISSIIVMGWSRQAPGKQRESLATISRGGTRTYADSVKGRFTISRDNAKNSSYLQMNSLRAEDTAVYYCYARYGDINYWGQGTLVTVSS

SEQ ID NO: 384 - protein, 115 aa, Artificial Sequence
  Description of Artificial Sequence: Synthetic polypeptide
EVQLVESGGGLVQPGGSLTLSCVASGSSFSITSMAWYRQAPGKQRDLVAAITSFGSTNYADSVKDRFTISRDNAKNSVYLQMNSLRAEDTAVYYCNGRVFDHVYWGQGTLVTVSS

SEQ ID NO: 385 - protein, 114 aa, Artificial Sequence
  Description of Artificial Sequence: Synthetic polypeptide
EVQLVESGGGLVQPGGSLTLSCAASGRTSMVNSMGWHRQAPGKQRELVALITSGGSSNYADTVKGRFTISRDNAKNSVYLQMNSLRAEDTAVYYCFYYFQSSYWGQGTLVTVSS

SEQ ID NO: 386 - protein, 116 aa, Artificial Sequence
  Description of Artificial Sequence: Synthetic polypeptide
EVQLVESGGGLVQPGGSLTLSCAASGSTFNFKIMAWHRQAPGKQRELVASLTSEGLTNYRDSVKGRFTISRDNAKNSVYLQMNSLRAEDTAVYYCGLWDGVGGAYWGQGTLVTVSS

SEQ ID NO: 387 - protein, 117 aa, Artificial Sequence
  Description of Artificial Sequence: Synthetic polypeptide
EVQLVESGGGLVQPGGSLTLSCAASGFTLDYYAIGWYRQAPGKKRELVAGISSDGSTHYVDSVKGRFTISRDNAKNSVYLQMNSLRAEDTAVYYCYAYRWVGGYTYWGQGTLVTVSS

SEQ ID NO: 388 - protein, 114 aa, Artificial Sequence
  Description of Artificial Sequence: Synthetic polypeptide
EVQLVESGGGLVQPGGSLTLSCVASGSIFTTNSMGWHRQGPGKQRELVALIGSAGSTKYADSVKGRFTISRDNAKNSVYLQMNSLRAEDTAVYYCFYYDSRSYWGQGTLVTVSS

SEQ ID NO: 389 - protein, 118 aa, Artificial Sequence
  Description of Artificial Sequence: Synthetic polypeptide
EVQLVESGGGLVQPGGSLTLSCAASGITSSVYSMGWYRQAPGKQRELVAGSSSDGSTHYVDSVRGRFTISRDNAKNSVYLQMNSLRAEDTAVYYCYANRGFAGAPSYWGQGTLVTVSS

SEQ ID NO: 390 - protein, 115 aa, Artificial Sequence
  Description of Artificial Sequence: Synthetic polypeptide
EVQLVESGGGLVQPGGSLTLSCAASSSIFSISSMSWYRQAPGKQRELVAAITSFGSTNYADSVKGRFTISRDNAKNSMYLQMNSLRAEDTAVYYCNARTMGRDYWGQGTLVTVSS

SEQ ID NO: 391 - protein, 119 aa, Artificial Sequence
  Description of Artificial Sequence: Synthetic polypeptide
EVQLVESGGGLVQPGGSLTLSCVASGFTSSINAMGWYRRAPGKQRELVAGISSDGSFVYADSVKGRFTISRDNAKNSVYLQMNSLRAEDTAVYYCYYFRHVSGSSMRYWGQGTLVTVSS

SEQ ID NO: 392 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTVSGSSSRYWGQGTLVTVSS

SEQ ID NO: 393 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYEDSVKGRFTISRDNAKNSVYLQMNSLRAEDTAVYYCYYFRTVSGSSMRYWGQGTLVTVSS

SEQ ID NO: 394 - protein, 119 aa, Artificial Sequence
  Description of Artificial Sequence: Synthetic polypeptide
EVQLVESGGGLVQPGGSLTLSCVASGSPSSINAMGWYRRAPGKQRELSAGISSDGSKVYADSVKGRFTISRDNAKNSVYLQMNSLRAEDTAVYYCYYFRTVRGSSMSYWGQGTLVTVSS

SEQ ID NO: 395 - protein, 119 aa, Artificial Sequence
  Description of Artificial Sequence: Synthetic polypeptide
EVQLVESGGGLVQPGGSLTLSCVASGSTSSINAMGWYRRAPGKQRELAAGISSDGSSVYADSVKGRFTISRDNAKNSVYLQMNSLRAEDTAVYYCYYFRTVSGSSKRYWGQGTLVTVSS

SEQ ID NO: 396 - protein, 119 aa, Artificial Sequence
  Description of Artificial Sequence: Synthetic polypeptide
EVQLVESGGGLVQPGGSLTLSCVASGSISSINAMGWYRRAPGKQRELVAGISSDGSKVYADSVKGRFTISRDNAKNSVYLQMNSLRAEDTAVYYCYYFRMVSGSSMRYWGQGTLVTVSS

SEQ ID NO: 397 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKLYADSVKGRFTISRDNAKNSVYLQMNSLRAEDTAVYYCYYFRTVQGSSMRYWGQGTLVTVSS

SEQ ID NO: 398 - protein, 119 aa, Artificial Sequence
  Description of Artificial Sequence: Synthetic polypeptide
EVQLVESGGGLVQPGGSLTLSCVASGSTSSINAYGWYRRAPGKQRELVAGISSDGSKVYADSVKGRFTISRDNAKNSVYLQMNSLRAEDTAVYYCYYFRTVYGSSMRYWGQGTLVTVSS

SEQ ID NO: 399 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYIDSVKGRFTISRDNAKNSVYLQMNSLRAEDTAVYYCYYFRTVSGSSYRYWGQGTLVTVSS

SEQ ID NO: 400 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYSDSVKGRFTISRDNAKNSVYLQMNSLRAEDTAVYYCYYFRTVLGSSMRYWGQGTLVTVSS

SEQ ID NO: 401 - protein, 119 aa, Artificial Sequence
  Description of Artificial Sequence: Synthetic polypeptide
EVQLVESGGGLVQPGGSLTLSCVASGSTSIINAMGWYRRAPGKQRELAAGISSDGSKVIADSVKGRFTISRDNAKNSVYLQMNSLRAEDTAVYYCYYFRRVSGSSMRYWGQGTLVTVSS

SEQ ID NO: 402 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKIYADSVKGRFTISRDNAKNSVYLQMNSLRAEDTAVYYCYYFRTVSGSSMRYWGQGTLVTVSS

SEQ ID NO: 403 - protein, 119 aa, Artificial Sequence
  Description of Artificial Sequence: Synthetic polypeptide
EVQLVESGGGLVQPGGSLTLSCVASGKTSSINAMAWYRRAPGKQRELVAGISSDGSKVYTDSVKGRFTISRDNAKNSVYLQMNSLRAEDTAVYYCYYFRTVSGSSARYWGQGTLVTVSS

SEQ ID NO: 404 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSLVYADSVKGRFTISRDNAKNSVYLQMNSLRAEDTAVYYCYYFRIVRGSSMRYWGQGTLVTVSS

SEQ ID NO: 405 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYYRTVSGSSMRYWGQGTLVTVSS

SEQ ID NO: 406 - protein, 119 aa, Artificial Sequence
  Description of Artificial Sequence: Synthetic polypeptide
EVQLVESGGGLVQPGGSLTLSCVASGSGSSINAMGWYRRAPGKQRELVAGISSDGSKVYSDSVKGRFTISRDNAKNSVYLQMNSLRAEDTAVYYCYYFRHVSGSSMRYWGQGTLVTVSS

SEQ ID NO: 407 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYVDSVKGRFTISRDNAKNSVYLQMNSLRAEDTAVYYCYYFRFVSGSSMRYWGQGTLVTVSS

SEQ ID NO: 408 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYVDSVKGRFTISRDNAKNSVYLQMNSLRAEDTAVYYCYYFRTVSGSSMRYWGQGTLVTVSS

SEQ ID NO: 409 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYADSVKGRFTISRDNAKNSVYLQMNSLRAEDTAVYYCYYFRTKSGSSMRYWGQGTLVTVSS

SEQ ID NO: 410 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYADSVKGRFTISRDNAKNSVYLQMNSLRAEDTAVYYCYYFRTVYGSSMRYWGQGTLVTVSS

SEQ ID NO: 411 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYRDSVKGRFTISRDNAKNSVYLQMNSLRAEDTAVYYCYYFRTVSGSSMGYWGQGTLVTVSS

SEQ ID NO: 412 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYSDSVKGRFTISRDNAKNSVYLQMNSLRAEDTAVYYCYYFRTVSGSSMRSWGQGTLVTVSS

SEQ ID NO: 413 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDNSKVYADSVKGRFTISRDNAKNSVYLQMNSLRAEDTAVYYCYYFRTVGGSSMRYWGQGTLVTVSS

SEQ ID NO: 414 - protein, 119 aa, Artificial Sequence
  Description of Artificial Sequence: Synthetic polypeptide
EVQLVESGGGLVQPGGSLTLSCVASGNTSSINAMAWYRRAPGKQRELVAGISSDGSKVYADSVKGRFTISRDNAKNSVYLQMNSLRAEDTAVYYCYYFRTVSGSSMRYWGQGTLVTVSS

SEQ ID NO: 415 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTVSGSHMRYWGQGTLVTVSS

SEQ ID NO: 416 - protein, 119 aa, Artificial Sequence
  Description of Artificial Sequence: Synthetic polypeptide
EVQLVESGGGLVQPGGSLTLSCVASGSTSIINAMGWYRRAPGKQRELVAGISSDGSKVYEDSVKGRFTISRDNAKNSVYLQMNSLRAEDTAVYYCYYFRAVSGSSMRYWGQGTLVTVSS

SEQ ID NO: 417 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTVSGSSMRYWGQGTLVTVSS

SEQ ID NO: 418 - protein, 119 aa, Artificial Sequence
  Description of Artificial Sequence: Synthetic polypeptide
EVQLVESGGGLVQPGGSLTLSCVASGSTSRINAMGWYRRAPGKQRELPAGISSDGSKVYAVSVKGRFTISRDNAKNSVYLQMNSLRAEDTAVYYCYYFRTVSGSPMRYWGQGTLVTVSS

SEQ ID NO: 419 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGVSSDGSKVYADSVKGRFTISRDNAKNSVYLQMNSLRAEDTAVYYCYYFRTVSGSSMSYWGQGTLVTVSS

SEQ ID NO: 420 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYEDSVKGRFTISRDNAKNSVYLQMNSLRAEDTAVYYCYYFRTVSGSSMRYWGQGTLVTVSS

SEQ ID NO: 421 - protein, 119 aa, Artificial Sequence
  Description of Artificial Sequence: Synthetic polypeptide
EVQLVESGGGLVQPGGSLTLSCVASGITSSINAMGWYRRAPGKQRELVAGISSDGSKVYAGSVKGRFTISRDNAKNSVYLQMNSLRAEDTAVYYCYYFRTVRGSSMRYWGQGTLVTVSS

SEQ ID NO: 422 - protein, 119 aa, Artificial Sequence
  Description of Artificial Sequence: Synthetic polypeptide
EVQLVESGGGLVQPGGSLTLSCVASGSTSDINAMGWYRRAPGKQRELVAGISSDKSKVYADSVKGRFTISRDNAKNSVYLQMNSLRAEDTAVYYCYYFRTVRGSSMRYWGQGTLVTVSS

SEQ ID NO: 423 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSNGSKVYADSVKGRFTISRDNAKNSVYLQMNSLRAEDTAVYYCYYFRQVSGSSMRYWGQGTLVTVSS

SEQ ID NO: 424 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVLADSVKGRFTISRDNAKNSVYLQMNSLRAEDTAVYYCYYFRIVSGSSMGYWGQGTLVTVSS

SEQ ID NO: 425 - protein, 119 aa, Artificial Sequence
  Description of Artificial Sequence: Synthetic polypeptide
EVQLVESGGGLVQPGGSLTLSCVASGSTSSKNAMGWYRRAPGKQRELVAGISSDGSKVYADSVKGRFTISRDNAKNSVYLQMNSLRAEDTAVYYCYYFRTVSGASMRYWGQGTLVTVSS

SEQ ID NO: 426 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDNSKVYADSVKGRFTISRDNAKNSVYLQMNSLRAEDTAVYYCYYFRTVHGSSMRYWGQGTLVTVSS

SEQ ID NO: 427 - protein, 119 aa, Artificial Sequence
  Description of Artificial Sequence: Synthetic polypeptide
EVQLVESGGGLVQPGGSLTLSCVASGLTSSINAMGWYRRAPGKQRELVAGISSDGSKVYADSVKGRFTISRDNAKNSVYLQMNSLRAEDTAVYYCYYFRMVSGSSMRYWGQGTLVTVSS

SEQ ID NO: 428 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYTDSVKGRFTISRDNAKNSVYLQMNSLRAEDTAVYYCYYFRTISGSSMRYWGQGTLVTVSS

SEQ ID NO: 429 - protein, 119 aa, Artificial Sequence
  Description of Artificial Sequence: Synthetic polypeptide
EVQLVESGGGLVQPGGSLTLSCVASGSTSSNNAMAWYRRAPGKQRELVAGISSDGSKVYTDSVKGRFTISRDNAKNSVYLQMNSLRAEDTAVYYCYYFRTRSGSSMRYWGQGTLVTVSS

SEQ ID NO: 430 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDNSKVYADSVKGRFTISRDNAKNSVYLQMNSLRAEDTAVYYCYYFRTVSGHSMRYWGQGTLVTVSS

SEQ ID NO: 431 - protein, 119 aa, Artificial Sequence
  Description of Artificial Sequence: Synthetic polypeptide
EVQLVESGGGLVQPGGSLTLSCVASGSTSHINAMGWYRRAPGKQRELVAGISSDGSRVYADSVKGRFTISRDNAKNSVYLQMNSLRAEDTAVYYCYYFRTVSGGSMRYWGQGTLVTVSS

SEQ ID NO: 432 - protein, 119 aa, Artificial Sequence
  Description of Artificial Sequence: Synthetic polypeptide
EVQLVESGGGLVQPGGSLTLSCVASGQTSSINAMGWYRRAPGKQRELVAGISSDGSQVYADSVKGRFTISRDNAKNSVYLQMNSLRAEDTAVYYCYYFRTKSGSSMRYWGQGTLVTVSS

SEQ ID NO: 433 - protein, 119 aa, Artificial Sequence
  Description of Artificial Sequence: Synthetic polypeptide
EVQLVESGGGLVQPGGSLTLSCVASGSTSRINGMGWYRRAPGKQRELPAGISSDGSKAYADSVKGRFTISRDNAKNSVYLQMNSLRAEDTAVYYCYYFRTASGTSMRYWGQGTLVTVSS

SEQ ID NO: 434 - protein, 119 aa, Artificial Sequence
  Description of Artificial Sequence: Synthetic polypeptide
EVQLVESGGGLVQPGGSLTLSCVASGSTSVINAMAWYRRAPGKQRELAAGISSDGSKVYAKSAKGRFTISRDNAKNSVYLQMNSLRAEDTAVYYCYYFNTVSGSSMRYWGQGTLVTVSS

SEQ ID NO: 435 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYNDSVKGRFTISRDNAKNSVYLQMNSLRAEDTAVYYCYYFRTVRGSSQRYWGQGTLVTVSS

SEQ ID NO: 436 - protein, 119 aa, Artificial Sequence
  Description of Artificial Sequence: Synthetic polypeptide
EVQLVESGGGLVQPGGSLTLSCVASGKTSSINAMGWYRRAPGKQRELVAGISSDGSKVIADSVKGRFTISRDNAKNSVYLQMNSLRAEDTAVYYCYYFRTVLGSSMRYWGQGTLVTVSS

SEQ ID NO: 437 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYTDSVKGRFTISRDNAKNSVYLQMNSLRAEDTAVYYCYYFRTRSGSSMRYWGQGTLVTVSS

SEQ ID NO: 438 - protein, 119 aa, Artificial Sequence
  Description of Artificial Sequence: Synthetic polypeptide
EVQLVESGGGLVQPGGSLTLSCVASGSVSSINAMGWYRRAPGKQRELVAGISSDGSKVYIDSVKGRFTISRDNAKNSVYLQMNSLRAEDTAVYYCYYFRTVSGLSMRYWGQGTLVTVSS

SEQ ID NO: 439 - protein, 119 aa, Artificial Sequence
  Description of Artificial Sequence: Synthetic polypeptide
EVQLVESGGGLVQPGGSLTLSCVASGNTSSINAMGWYRRAPGKQRELVAGISSDGSKVYYDSVKGRFTISRDNAKNSVYLQMNSLRAEDTAVYYCYYFRTVRGSSQRYWGQGTLVTVSS

SEQ ID NO: 440 - protein, 119 aa, Artificial Sequence
  Description of Artificial Sequence: Synthetic polypeptide
EVQLVESGGGLVQPGGSLTLSCVASGSTSSTNAMGWYRRAPGKQRELVAGISSDGSKVYVDSVKGRFTISRDNAKNSVYLQMNSLRAEDTAVYYCYYFRTVSGSSMVYWGQGTLVTVSS

SEQ ID NO: 441 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYGDSVKGRFTISRDNAKNSVYLQMNSLRAEDTAVYYCYYFRTVSRSSMRYWGQGTLVTVSS

SEQ ID NO: 442 - protein, 119 aa, Artificial Sequence
  Description of Artificial Sequence: Synthetic polypeptide
EVQLVESGGGLVQPGGSLTLSCVASGSTSSINAMAWYRRAPGKQRELAAGISSDQSKVYADSAKGRFTISRDNAKNSVYLQMNSLRAEDTAVYYCYYFRTVSGSSMSYWGQGTLVTVSS

SEQ ID NO: 443 - protein, 119 aa, Artificial Sequence
  Description of Artificial Sequence: Synthetic polypeptide
EVQLVESGGGLVQPGGSLTLSCVASGGTSSINAMGWYRRAPGKQRELVAGISSDGSKVYSDSVKGRFTISRDNAKNSVYLQMNSLRAEDTAVYYCYYFRTVSGSSARYWGQGTLVTVSS

SEQ ID NO: 444 - protein, 119 aa, Artificial Sequence
  Description of Artificial Sequence: Synthetic polypeptide
EVQLVESGGGLVQPGGSLTLSCVASGSTRSINAMGWYRRAPGKQRELVAGISSDGSKVYADSVKGRFTISRDNAKNSVYLQMNSLRAEDTAVYYCYYFHTVSGSSMRYWGQGTLVTVSS

SEQ ID NO: 445 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVIADSVKGRFTISRDNAKNSVYLQMNSLRAEDTAVYYCYYFRTVLGSSMRYWGQGTLVTVSS

SEQ ID NO: 446 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVDADSVKGRFTISRDNAKNSVYLQMNSLRAEDTAVYYCYYFRTVSGSSMRYWGQGTLVTVSS

SEQ ID NO: 447 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYKDSVKGRFTISRDNAKNSVYLQMNSLRAEDTAVYYCYYFRNVSGSSMRYWGQGTLVTVSS

SEQ ID NO: 448 - protein, 119 aa, Artificial Sequence
  Description of Artificial Sequence: Synthetic polypeptide
EVQLVESGGGLVQPGGSLTLSCVASGNTSSINAMGWYRRAPGKQRELVAGISSNGSKVYADSVKGRFTISRDNAKNSVYLQMNSLRAEDTAVYYCYYFRTVTGSSMRYWGQGTLVTVSS

SEQ ID NO: 449 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYKDSVKGRFTISRDNAKNSVYLQMNSLRAEDTAVYYCYYFRTVSGSSMRYWGQGTLVTVSS

SEQ ID NO: 450 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYADSVKGRFTISRDNAKNSVYLQMNSLRAEDTAVYYCYYFRTVKGSSMRYWGQGTLVTVSS

SEQ ID NO: 451 - protein, 119 aa, Artificial Sequence
  Description of Artificial Sequence: Synthetic polypeptide
EVQLVESGGGLVQPGGSLTLSCVASGLTSSINAMGWYRRAPGKQRELVAGISSDGSKVYQDSVKGRFTISRDNAKNSVYLQMNSLRAEDTAVYYCYYFRTNSGSSMRYWGQGTLVTVSS

SEQ ID NO: 452 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYAESVKGRFTISRDNAKNSVYLQMNSLRAEDTAVYYCYYFRTVSGASMRYWGQGTLVTVSS

SEQ ID NO: 453 - protein, 119 aa, Artificial Sequence
  Description of Artificial Sequence: Synthetic polypeptide
EVQLVESGGGLVQPGGSLTLSCVASGSTSSTNAMGWYRRAPGKQRELVAGISSDGSKVLADSVKGRFTISRDNAKNSVYLQMNSLRAEDTAVYYCYYFRTVNLSSMRYWGQGTLVTVSS

SEQ ID NO: 454 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKYYADSVKGRFTISRDNAKNSVYLQMNSLRAEDTAVYYCYYFRTVTGSSMRYWGQGTLVTVSS

SEQ ID NO: 455 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYAVSVKGRFTISRDNAKNSVYLQMNSLRAEDTAVYYCYYFRKVSGSSARYWGQGTLVTVSS

SEQ ID NO: 456 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVVADSVKGRFTISRDNAKNSVYLQMNSLRAEDTAVYYCYYFRTYSGSSMRYWGQGTLVTVSS

SEQ ID NO: 457 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYADSVKGRFTISRDNAKNSVYLQMNSLRAEDTAVYYCYYFRTVSKSSMRYWGQGTLVTVSS

SEQ ID NO: 458 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFKTVSGSSMRYWGQGTLVTVSS

SEQ ID NO: 459 - protein, 119 aa, Artificial Sequence
  Description of Artificial Sequence: Synthetic polypeptide
EVQLVESGGGLVQPGGSLTLSCVASGSTSSINAMAWYRRAPGKQRELAAGISSDNSKVYADSVKGRFTISRDNAKNSVYLQMNSLRAEDTAVYYCYYFRTRSGSSMRYWGQGTLVTVSS

SEQ ID NO: 460 - protein, 119 aa, Artificial Sequence
  Description of Artificial Sequence: Synthetic polypeptide
EVQLVESGGGLVQPGGSLTLSCVASGSKSSINAMGWYRRAPGKQRELAAGISSDGSKVYAQSVKGRFTISRDNAKNSVYLQMNSLRAEDTAVYYCYYFRTSSGSSMRYWGQGTLVTVSS

SEQ ID NO: 461 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYVDSVKGRFTISRDNAKNSVYLQMNSLRAEDTAVYYCYYFRFLSGSSMRYWGQGTLVTVSS

SEQ ID NO: 462 - protein, 119 aa, Artificial Sequence
  Description of Artificial Sequence: Synthetic polypeptide
EVQLVESGGGLVQPGGSLTLSCVASGSTSSINAFGWYRRAPGKQRELVAGISSDGSKVYSDSVKGRFTISRDNAKNSVYLQMNSLRAEDTAVYYCYYFRTVSGSSMRYWGQGTLVTVSS

SEQ ID NO: 463 - protein, 119 aa, Artificial Sequence
  Description of Artificial Sequence: Synthetic polypeptide
EVQLVESGGGLVQPGGSLTLSCVASGSTFSINAMGWYRRAPGKQRELVAGISSDGSKVLADSVKGRFTISRDNAKNSVYLQMNSLRAEDTAVYYCYYFRLVSGSSMRYWGQGTLVTVSS

SEQ ID NO: 464 - protein, 119 aa, Artificial Sequence
  Description of Artificial Sequence: Synthetic polypeptide
EVQLVESGGGLVQPGGSLTLSCVASGSTRSINAMGWYRRAPGKQRELVAGISSDGSKVYNDSVKGRFTISRDNAKNSVYLQMNSLRAEDTAVYYCYYFRTVSGSSMRFWGQGTLVTVSS

SEQ ID NO: 465 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYNDSVKGRFTISRDNAKNSVYLQMNSLRAEDTAVYYCYYFRTQSGSSMRYWGQGTLVTVSS

SEQ ID NO: 466 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYVDSVKGRFTISRDNAKNSVYLQMNSLRAEDTAVYYCYYFRTVSGSSMPYWGQGTLVTVSS

SEQ ID NO: 467 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVVADSVKGRFTISRDNAKNSVYLQMNSLRAEDTAVYYCYYFRTLSGSSMRYWGQGTLVTVSS

SEQ ID NO: 468 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYGDSVKGRFTISRDNAKNSVYLQMNSLRAEDTAVYYCYYFRTVSGSAMRYWGQGTLVTVSS

SEQ ID NO: 469 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYTDSVKGRFTISRDNAKNSVYLQMNSLRAEDTAVYYCYYFRTTSGSSMRYWGQGTLVTVSS

SEQ ID NO: 470 - protein, 119 aa, Artificial Sequence
  Description of Artificial Sequence: Synthetic polypeptide
EVQLVESGGGLVQPGGSLTLSCVASGRTSSINAMGWYRRAPGKQRELVAGISSDGSKVYNDSVKGRFTISRDNAKNSVYLQMNSLRAEDTAVYYCYYFRTVSGTSMRYWGQGTLVTVSS

SEQ ID NO: 471 - protein, 119 aa, Artificial Sequence
  Description of Artificial Sequence: Synthetic polypeptide
EVQLVESGGGLVQPGGSLTLSCVASGSTSSRNAMGWYRRAPGKQRELVAGISSDGSKVTADSVKGRFTISRDNAKNSVYLQMNSLRAEDTAVYYCYYFRTRSGSSMRYWGQGTLVTVSS

SEQ ID NO: 472 - protein, 119 aa, Artificial Sequence
  Description of Artificial Sequence: Synthetic polypeptide
EVQLVESGGGLVQPGGSLTLSCVASGSTKSINAMGWYRRAPGKQRELVAGISSDGSKVYRDSVKGRFTISRDNAKNSVYLQMNSLRAEDTAVYYCYYFRTSSGSSMRYWGQGTLVTVSS

SEQ ID NO: 473 - protein, 119 aa, Artificial Sequence
  Description of Artificial Sequence: Synthetic polypeptide
EVQLVESGGGLVQPGGSLTLSCVASGSTSSRNAMGWYRRAPGKQRELVAGISSNGSKVYSDSVKGRFTISRDNAKNSVYLQMNSLRAEDTAVYYCYYFRTVSGSSMSYWGQGTLVTVSS

SEQ ID NO: 474 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYSDSVKGRFTISRDNAKNSVYLQMNSLRAEDTAVYYCYYFRPVSGSSMRYWGQGTLVTVSS

SEQ ID NO: 475 - protein, 119 aa, Artificial Sequence
  Description of Artificial Sequence: Synthetic polypeptide
EVQLVESGGGLVQPGGSLTLSCVASGSTSLINAMGWYRRAPGKQRELVAGISSDGSKVYADSVKGRFTISRDNAKNSVYLQMNSLRAEDTAVYYCYYFRHVSGSSMRYWGQGTLVTVSS

SEQ ID NO: 476 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTKSGSSMRYWGQGTLVTVSS

SEQ ID NO: 477 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSLVYADSVKGRFTISRDNAKNSVYLQMNSLRAEDTAVYYCYYFTTVSGSSMRYWGQGTLVTVSS

SEQ ID NO: 478 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGTKVYADSVKGRFTISRDNAKNSVYLQMNSLRAEDTAVYYCYYFHTVSGSSMRYWGQGTLVTVSS

SEQ ID NO: 479 - protein, 119 aa, Artificial Sequence
  Description of Artificial Sequence: Synthetic polypeptide
EVQLVESGGGLVQPGGSLTLSCVASGSTSSINAFGWYRRAPGKQRELVAGISSDGSKVYADSVKGRFTISRDNAKNSVYLQMNSLRAEDTAVYYCYYFRTVRGSSMRYWGQGTLVTVSS

SEQ ID NO: 480 - protein, 119 aa, Artificial Sequence
  Description of Artificial Sequence: Synthetic polypeptide
EVQLVESGGGLVQPGGSLTLSCVASGSTSSRNAMGWYRRAPGKQRELVAGISSDGSKLYLDSVKGRFTISRDNAKNSVYLQMNSLRAEDTAVYYCYYFRTVLGSSMRYWGQGTLVTVSS

SEQ ID NO: 481 - protein, 119 aa, Artificial Sequence
  Description of Artificial Sequence: Synthetic polypeptide
EVQLVESGGGLVQPGGSLTLSCVASGNTSSINAMGWYRRAPGKQRELVAGISSDGSRVYADSVKGRFTISRDNAKNSVYLQMNSLRAEDTAVYYCYYFRTVSGSSMRSWGQGTLVTVSS

SEQ ID NO: 482 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYNDSVKGRFTISRDNAKNSVYLQMNSLRAEDTAVYYCYYFRTVRGSSMRYWGQGTLVTVSS

SEQ ID NO: 483 - protein, 119 aa, Artificial Sequence
  Description of Artificial Sequence: Synthetic polypeptide
EVQLVESGGGLVQPGGSLTLSCVASGSTASINAMGWYRRAPGKQRELVAGISSDGSKVYADSVKGRFTISRDNAKNSVYLQMNSLRAEDTAVYYCYYFRYVSGSSMRYWGQGTLVTVSS

SEQ ID NO: 484 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSKVYVDSVKGRFTISRDNAKNSVYLQMNSLRAEDTAVYYCYYFRTVYGSSMRYWGQGTLVTVSS

SEQ ID NO: 485 - protein, 119 aa, Artificial Sequence
  Description of Artificial Sequence: Synthetic polypeptide
EVQLVESGGGLVQPGGSLTLSCVASGSTSSRNAMGWYRRAPGKQRELVAGISSDGSKLYADSVKGRFTISRDNAKNSVYLQMNSLRAEDTAVYYCYYFRTVLGSSMRYWGQGTLVTVSS

SEQ ID NO: 486 - protein, 119 aa, Artificial Sequence
  Description of Artificial Sequence: Synthetic polypeptide
EVQLVESGGGLVQPGGSLTLSCVASGSTNSINAMGWYRRAPGKQRELVAGISSDGSKVYKDSVKGRFTISRDNAKNSVYLQMNSLRAEDTAVYYCYYYRTVSGSSMRYWGQGTLVTVSS

SEQ ID NO: 487 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRSVSGSSMRYWGQGTLVTVSS

SEQ ID NO: 488 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYQDSVKGRFTISRDNAKNSVYLQMNSLRAEDTAVYYCYYFRRVSGSSMRYWGQGTLVTVSS

SEQ ID NO: 489 - protein, 119 aa, Artificial Sequence
  Description of Artificial Sequence: Synthetic polypeptide
EVQLVESGGGLVQPGGSLTLSCVPSGSTSNINAMGWYRRAPGKQRELPAGISSDGTKIYADSAKVPFTITRDNAKNSVYLQMNSLRAEDTAVYYCYYFRTVSGTSMRYWGQGTLVTVSS

SEQ ID NO: 490 - protein, 119 aa, Artificial Sequence
  Description of Artificial Sequence: Synthetic polypeptide
EVQLVESGGGLVQPGGSLTLSCVASGSTSKINAMGWYRRAPGKQRELVAGISSDRSKVYADSVKGRFTISRDNAKNSVYLQMNSLRAEDTAVYYCYYFRTVAGSSMRYWGQGTLVTVSS

SEQ ID NO: 491 - protein, 119 aa, Artificial Sequence
  Description of Artificial Sequence: Synthetic polypeptide
EVQLVESGGGLVQPGGSLTLSCVASGSTSSINALGWYRRAPGKQRELVAGISSDGSLVYADSVKGRFTISRDNAKNSVYLQMNSLRAEDTAVYYCYYFRIVSGSSMRYWGQGTLVTVSS

SEQ ID NO: 492 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYADSVKGRFTISRDNAKNSVYLQMNSLRAEDTAVYYCYYFRTASGSSMRYWGQGTLVTVSS

SEQ ID NO: 493 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYSDSVKGRFTISRDNAKNSVYLQMNSLRAEDTAVYYCYYFRTVSGSSSRYWGQGTLVTVSS

SEQ ID NO: 494 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGTKVYRDSVKGRFTISRDNAKNSVYLQMNSLRAEDTAVYYCYYFRTVQGSSMRYWGQGTLVTVSS

SEQ ID NO: 495 - protein, 119 aa, Artificial Sequence
  Description of Artificial Sequence: Synthetic polypeptide
EVQLVESGGGLVQPGGSLTLSCVASGTTSSINAMGWYRRAPGKQRELAAGISSDGSKVYNDSVKGRFTISRDNAKNSVYLQMNSLRAEDTAVYYCYYFRTVRGSSMRYWGQGTLVTVSS

SEQ ID NO: 496 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYADSVKGRFTISRDNAKNSVYLQMNSLRAEDTAVYYCYYFRTKSGSSMRYWGQGTLVTVSS

SEQ ID NO: 497 - protein, 119 aa, Artificial Sequence
  Description of Artificial Sequence: Synthetic polypeptide
EVQLVESGGGLVQPGGSLTLSCVASGTTSSINAMGWYRRAPGKQRELVAGISSDGSKVYADSVKGRFTISRDNAKNSVYLQMNSLRAEDTAVYYCYYFRTVWGSSMRYWGQGTLVTVSS

SEQ ID NO: 498 - protein, 119 aa, Artificial Sequence
  Description of Artificial Sequence: Synthetic polypeptide
EVQLVESGGGLVQPGGSLTLSCVASGKTSSINAMGWYRRAPGKQRELVAGISSDGSKVYTDSVKGRFTISRDNAKNSVYLQMNSLRAEDTAVYYCYYFRTRSGSSMRYWGQGTLVTVSS

SEQ ID NO: 499 - protein, 119 aa, Artificial Sequence
  Description of Artificial Sequence: Synthetic polypeptide
EVQLVESGGGLVQPGGSLTLSCVASGSTSSINAMGWYRRAPFKQGELPAGISPDGTKAYADSAKVRFTISRDNAKNSVYLQMNSLRAEDTAVYYCYYFHTVCGTSMGYWGQGTLVTVSS

SEQ ID NO: 500 - protein, 119 aa, Artificial Sequence
  Description of Artificial Sequence: Synthetic polypeptide
EVQLVESGGGLVQPGGSLTLSCVASGSTSAINAMGWYRRAPGKQRELVAGISSDGSKVYVDSVKGRFTISRDNAKNSVYLQMNSLRAEDTAVYYCYYFRTVSGSSQRYWGQGTLVTVSS

SEQ ID NO: 501 - protein, 119 aa, Artificial Sequence
  Description of Artificial Sequence: Synthetic polypeptide
EVQLVESGGGLVQPGGSLTLSCVASGSPSSINAYGWYRRAPGKQRELVAGISSDGSKVYSDSVKGRFTISRDNAKNSVYLQMNSLRAEDTAVYYCYYFRTVSGSSMSYWGQGTLVTVSS

SEQ ID NO: 502 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYASSVKGRFTISRDNAKNSVYLQMNSLRAEDTAVYYCYYFRTVRGSSMRYWGQGTLVTVSS

SEQ ID NO: 503 - protein, 119 aa, Artificial Sequence
  Description of Artificial Sequence: Synthetic polypeptide
EVQLVESGGGLVQPGGSLTLSCVASGSRSSINAMGWYRRAPGKQRELVAGISADGSKVYADSVKGRFTISRDNAKNSVYLQMNSLRAEDTAVYYCYYFRTQSGSSMRYWGQGTLVTVSS

SEQ ID NO: 504 - protein, 119 aa, Artificial Sequence
  Description of Artificial Sequence: Synthetic polypeptide
EVQLVESGGGLVQPGGSLTLSCVASGSVSSINAMGWYRRAPGKQRELVAGISSDGSKVYASSAKGRFTISRDNAKNSVYLQMNSLRAEDTAVYYCYYFRTLSGSSMRYWGQGTLVTVSS

SEQ ID NO: 505 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFHTVSGSSMRYWGQGTLVTVSS

SEQ ID NO: 506 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSSVYADSVKGRFTISRDNAKNSVYLQMNSLRAEDTAVYYCYYFRRVSGSSMRYWGQGTLVTVSS

SEQ ID NO: 507 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSKVYSDSVKGRFTISRDNAKNSVYLQMNSLRAEDTAVYYCYYFRLVSGSSMRYWGQGTLVTVSS

SEQ ID NO: 508 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSKVYAGSVKGRFTISRDNAKNSVYLQMNSLRAEDTAVYYCYYFRTVSGSYMRYWGQGTLVTVSS

SEQ ID NO: 509 - protein, 119 aa, Artificial Sequence
  Description of Artificial Sequence: Synthetic polypeptide
EVQLVESGGGLVQPGGSLTLSCVASGSTSSINAMAWYRRAPGKQRELAAGISSDNSKVYADSVKGRFTISRDNAKNSVYLQMNSLRAEDTAVYYCYYFRTVGGSSMRYWGQGTLVTVSS

SEQ ID NO: 510 - protein, 119 aa, Artificial Sequence
  Description of Artificial Sequence: Synthetic polypeptide
EVQLVESGGGLVQPGGSLTLSCVASGSTSSINAYGWYRRAPGKQRELVAGISSDGSAVYADSVKGRFTISRDNAKNSVYLQMNSLRAEDTAVYYCYYFRTHSGSSMRYWGQGTLVTVSS

SEQ ID NO: 511 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSSVYADSVKGRFTISRDNAKNSVYLQMNSLRAEDTAVYYCYYFRTVSTSSMRYWGQGTLVTVSS

SEQ ID NO: 512 - protein, 119 aa, Artificial Sequence
  Description of Artificial Sequence: Synthetic polypeptide
EVQLVESGGGLVQPGGSLTLSCVASGSKSSINAMGWYRRAPGKQRELPAGISSNGTKVYADSAKVRFTISRDNAKNSVYLQMNSLRAEDTAVYYCYYFRTVLGTSMRYWGQGTLVTVSS

SEQ ID NO: 513 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKLYADSVKGRFTISRDNAKNSVYLQMNSLRAEDTAVYYCYYFRTVSGSSMRYWGQGTLVTVSS

SEQ ID NO: 514 - protein, 119 aa, Artificial Sequence
  Description of Artificial Sequence: Synthetic polypeptide
EVQLVESGGGLVQPGGSLTLSCVASGSVSSINAMGWYRRAPGKQRELVAGISSDGSKVYKDSVKGRFTISRDNAKNSVYLQMNSLRAEDTAVYYCYYFRTVSGSSMGYWGQGTLVTVSS

SEQ ID NO: 515 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSLVYADSVKGRFTISRDNAKNSVYLQMNSLRAEDTAVYYCYYFRTVSGSSMRAWGQGTLVTVSS

SEQ ID NO: 516 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSLVYADSVKGRFTISRDNAKNSVYLQMNSLRAEDTAVYYCYYFRILSGSSMRYWGQGTLVTVSS

SEQ ID NO: 517 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRTVQGSSMRYWGQGTLVTVSS

SEQ ID NO: 518 - protein, 119 aa, Artificial Sequence
  Description of Artificial Sequence: Synthetic polypeptide
EVQLVESGGGLVQPGGSLTLSCVASGSTSYINAMGWYRRAPGKQRELVAGISSDGSKVYADSVKGRFTISRDNAKNSVYLQMNSLRAEDTAVYYCYYFRTVSGQSMGYWGQGTLVTVSS

SEQ ID NO: 519 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSTVYADSVKGRFTISRDNAKNSVYLQMNSLRAEDTAVYYCYYFRTVSGHSMRYWGQGTLVTVSS

SEQ ID NO: 520 - protein, 119 aa, Artificial Sequence
  Description of Artificial Sequence: Synthetic polypeptide
EVQLVESGGGLVQPGGSLTLSCVASGSTSSINAMGWYRRAPGKQRELAAGISKDGSKVYADSAKGRFTISRDNAKNSVYLQMNSLRAEDTAVYYCYYFRTVSGSSSRYWGQGTLVTVSS

SEQ ID NO: 521 - protein, 119 aa, Artificial Sequence
  Description of Artificial Sequence: Synthetic polypeptide
EVQLVESGGGLVQPGGSLTLSCVASGSPSSINAYGWYRRAPGKQRELVAGISSDGSKVYSDSVKGRFTISRDNAKNSVYLQMNSLRAEDTAVYYCYYFRTVSGSSYSYWGQGTLVTVSS

SEQ ID NO: 522 - protein, 119 aa, Artificial Sequence
  Description of Artificial Sequence: Synthetic polypeptide
EVQLVESGGGLVQPGGSLTLSCVASGSPSSINAYGWYRRAPGKQRELVAGISSDGSKVYSDSVKGRFTISRDNAKNSVYLQMNSLRAEDTAVYYCYYFRTVSGSSQSYWGQGTLVTVSS

SEQ ID NO: 523 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYIDSVKGRFTISRDNAKNSVYLQMNSLRAEDTAVYYCYAYRWTRRYTYWGQGTLVTVSS

SEQ ID NO: 524 - protein, 117 aa, Artificial Sequence
  Description of Artificial Sequence: Synthetic polypeptide
EVQLVESGGGLVQPGGSLTLSCAASGSSVSFLSLAWYRQAPGKKRELVAGISADGSTAYIDSVKGRFTISRDNAKNSVYLQMNSLRAEDTAVYYCYAYRWRTRYTYWGQGTLVTVSS

SEQ ID NO: 525 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISRDGSTDYIDSVKGRFTISRDNAKNSVYLQMNSLRAEDTAVYYCYAYRWTTRRTYWGQGTLVTVSS

SEQ ID NO: 526 - protein, 117 aa, Artificial Sequence
  Description of Artificial Sequence: Synthetic polypeptide
EVQLVESGGGLVQPGGSLTLSCAASGSQVSFLSMAWYRQAPGKKRELVAGISRDGSTDYIDSVKGRFTISRDNAKNSVYLQMNSLRAEDTAVYYCYAYRWTTRYIYWGQGTLVTVSS

SEQ ID NO: 527 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISEAGSTDYIDSVKGRFTISRDNAKNSVYLQMNSLRAEDTAVYYCYAYRWRTRYTYWGQGTLVTVSS

SEQ ID NO: 528 - protein, 117 aa, Artificial Sequence
  Description of Artificial Sequence: Synthetic polypeptide
EVQLVESGGGLVQPGGSLTLRCAASGSKVSFLSMAWYRQAPGKKRELVAGISADGSTDYVDSVKGRFTISRDNAKNSVYLQMNSLRAEDTAVYYCYAYRWTRRYTYWGQGTLVTVSS

SEQ ID NO: 529 - protein, 117 aa, Artificial Sequence
  Description of Artificial Sequence: Synthetic polypeptide
EVQLVESGGGLVQPGGSLTLSCAASGSSVGFLSMAWYRQAPGKKRELVAGISADGSTDYIRSVKGRFTISRDNAKNSVYLQMNSLRAEDTAVYYCYAYRWRTRYTYWGQGTLVTVSS

SEQ ID NO: 530 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSVDYIDSVKGRFTISRDNAKNSVYLQMNSLRAEDTAVYYCYAYRWTTRYIYWGQGTLVTVSS

SEQ ID NO: 531 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTLYIDSVKGRFTISRDNAKNSVYLQMNSLRAEDTAVYYCYAYRWTTRRTYWGQGTLVTVSS

SEQ ID NO: 532 - protein, 117 aa, Artificial Sequence
  Description of Artificial Sequence: Synthetic polypeptide
EVQLVESGGGLVQPGGSLTLSCAASGSSVSFLSLAWYRQAPGKKRELVAGISTDGSTDYIDSVKGRFTISRDNAKNSVYLQMNSLRAEDTAVYYCYAYRWRTRYTYWGQGTLVTVSS

SEQ ID NO: 533 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISGDGSTDYIDSVKGRFTISRDNAKNSVYLQMNSLRAEDTAVYYCYAYRWTTRYTYWGQGTLVTVSS

SEQ ID NO: 534 - protein, 117 aa, Artificial Sequence
  Description of Artificial Sequence: Synthetic polypeptide
EVQLVESGGGLVQPGGSLTLSCAASGSSVQFLSMAWYRQAPGKKRELVAGISADGSTDYINSVKGRFTISRDNAKNSVYLQMNSLRAEDTAVYYCYAYRWRTRYTYWGQGTLVTVSS

SEQ ID NO: 535 - protein, 117 aa, Artificial Sequence
  Description of Artificial Sequence: Synthetic polypeptide
EVQLVESGGGLVQPGGSLTLSCAASGSNVSFLSMAWYRQAPGKKRELVAGISARGSTDYIDSVKGRFTISRDNAKNSVYLQMNSLRAEDTAVYYCYAYHWTTRYTYWGQGTLVTVSS

SEQ ID NO: 536 - protein, 117 aa, Artificial Sequence
  Description of Artificial Sequence: Synthetic polypeptide
EVQLVESGGGLVQPGGSLTLSCVASGSSVKFLSMAWYRQAPGKKRELVAGISADGSTTYIDSVKGRFTISRDNAKNSVYLQMNSLRAEDTAVYYCYAYRWTTRRTYWGQGTLVTVSS

SEQ ID NO: 537 - protein, 117 aa, Artificial Sequence
  Description of Artificial Sequence: Synthetic polypeptide
EVQLVESGGGLVQPGGSLTLSCAASGKSVSFLSMAWYRQAPGKKRELVAGISKDGSTDYIDSVKGRFTISRDNAKNSVYLQMNSLRAEDTAVYYCYAYRWTTRYTYWGQGTLVTVSS

SEQ ID NO: 538 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTTYIDSVKGRFTISRDNAKNSVYLQMNSLRAEDTAVYYCYAYRWTTRYTYWGQGTLVTVSS

SEQ ID NO: 539 - protein, 117 aa, Artificial Sequence
  Description of Artificial Sequence: Synthetic polypeptide
EVQLVESGGGLVQPGGSLTLSCAASGSHVSFLSMAWYRQAPGKKRELVAGISANGSTDYIDSVKGRFTISRDNAKNSVYLQMNSLRAEDTAVYYCYAYRWTTRYAYWGQGTLVTVSS

SEQ ID NO: 540 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISRDGSTDYIDSVKGRFTISRDNAKNSVYLQMNSLRAEDTAVYYCYAYRWVTRYTYWGQGTLVTVSS

SEQ ID NO: 541 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSADYIDSVKGRFTISRDNAKNSVYLQMNSLRAEDTAVYYCYAYRWVTRYTYWGQGTLVTVSS

SEQ ID NO: 542 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISAHGSTDYIDSVKGRFTISRDNAKNSVYLQMNSLRAEDTAVYYCYAYRWSTRYTYWGQGTLVTVSS

SEQ ID NO: 543 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTIYIDSVKGRFTISRDNAKNSVYLQMNSLRAEDTAVYYCYAYRWRTRYTYWGQGTLVTVSS

SEQ ID NO: 544 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTVYIDSVKGRFTISRDNAKNSVYLQMNSLRAEDTAVYYCYAYRWTTRGTYWGQGTLVTVSS

SEQ ID NO: 545 - protein, 117 aa, Artificial Sequence
  Description of Artificial Sequence: Synthetic polypeptide
EVQLVESGGGLVQPGGSLTLSCAASGSHVSFLSMAWYRQAPGKKRELVAGISADGPTDYIDSVKGRFTISRDNAKNSVYLQMNSLRAEDTAVYYCYAYRWDTRYTYWGQGTLVTVSS

SEQ ID NO: 546 - protein, 117 aa, Artificial Sequence
  Description of Artificial Sequence: Synthetic polypeptide
EVQLVESGGGLVQPGGSLTLSCVASGTSVSFLSMAWYRQAPGKKRELVAGISADGSTTYIDSVKGRFTISRDNAKNSVYLQMNSLRAEDTAVYYCYAYRWTTRRTYWGQGTLVTVSS

SEQ ID NO: 547 - protein, 117 aa, Artificial Sequence
  Description of Artificial Sequence: Synthetic polypeptide
EVQLVESGGGLVQPGGSLTLSCAASGTSVSFLSIAWYRQAPGKKRELVAGISADGSTDYIASVKGRFTISRDNAKNSVYLQMNSLRAEDTAVYYCYAYRWRTRYTYWGQGTLVTVSS

SEQ ID NO: 548 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISLDGSTDYIDSVKGRFTISRDNAKNSVYLQMNSLRAEDTAVYYCYAYRWTGRYTYWGQGTLVTVSS

SEQ ID NO: 549 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTIYIDSVKGRFTISRDNAKNSVYLQMNSLRAEDTAVYYCYAYRWRTRYTYWGQGTLVTVSS

SEQ ID NO: 550 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISAHGSTDYIDSVKGRFTISRDNAKNSVYLQMNSLRAEDTAVYYCYAYRWRTRYTYWGQGTLVTVSS

SEQ ID NO: 551 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISRDGSTDYIDSVKGRFTISRDNAKNSVYLQMNSLRAEDTAVYYCYAYRWITRYTYWGQGTLVTVSS

SEQ ID NO: 552 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTDYIDSVKGRFTISRDNAKNSVYLQMNSLRAEDTAVYYCYAYRWITRYTYWGQGTLVTVSS

SEQ ID NO: 553 - protein, 117 aa, Artificial Sequence
  Description of Artificial Sequence: Synthetic polypeptide
EVQLVESGGGLVQPGGSLTLSCAASGSSVVFLSMAWYRQAPGKKRELVAGISADGSMDYIDSVKGRFTISRDNAKNSVYLQMNSLRAEDTAVYYCYAYRWRTRYTYWGQGTLVTVSS

SEQ ID NO: 554 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTDYIDSVKGRFTISRDNAKNSVYLQMNSLRAEDTAVYYCYAYRWTRRYTYWGQGTLVTVSS

SEQ ID NO: 555 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTDYIDSVKGRFTISRDNAKNSVYLQMNSLRAEDTAVYYCYAYSWTTRYTYWGQGTLVTVSS

SEQ ID NO: 556 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISANGSTDYIDSVKGRFTISRDNAKNSVYLQMNSLRAEDTAVYYCYAYRWTNRYTYWGQGTLVTVSS

SEQ ID NO: 557 - protein, 117 aa, Artificial Sequence
  Description of Artificial Sequence: Synthetic polypeptide
EVQLVESGGGLVQPGGSLTLSCAASGSSVSRLSMAWYRQAPGKKRELVAGISANGSTTYIDSVKGRFTISRDNAKNSVYLQMNSLRAEDTAVYYCYAYRWTTRYRYWGQGTLVTVSS

SEQ ID NO: 558 - protein, 117 aa, Artificial Sequence
  Description of Artificial Sequence: Synthetic polypeptide
EVQLVESGGGLVQPGGSLTLSCAASGSSKSFLSMAWYRQAPGKKRELVAGISADGSTSYIDSVKGRFTISRDNAKNSVYLQMNSLRAEDTAVYYCYAYRWTTRYTYWGQGTLVTVSS

SEQ ID NO: 559 - protein, 117 aa, Artificial Sequence
  Description of Artificial Sequence: Synthetic polypeptide
EVQLVESGGGLVQPGGSLTLSCAASGSSVSRLSMAWYRQAPGKKRELVAGISADGSRDYIDSVKGRFTISRDNAKNSVYLQMNSLRAEDTAVYYCYAYRWTTRYKYWGQGTLVTVSS

SEQ ID NO: 560 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTMYIDSVKGRFTISRDNAKNSVYLQMNSLRAEDTAVYYCYAYRWHTRYTYWGQGTLVTVSS

SEQ ID NO: 561 - protein, 117 aa, Artificial Sequence
  Description of Artificial Sequence: Synthetic polypeptide
EVQLVESGGGLVQPGGSLTLSCAASGSGVRFLSMAWYRQAPGKKRELVAGISPDGSTDYIDSVKGRFTISRDNAKNSVYLQMNSLRAEDTAVYYCYAYRWTRRYTYWGQGTLVTVSS

SEQ ID NO: 562 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISGDGSTDYIDSVKGRFTISRDNAKNSVYLQMNSLRAEDTAVYYCYAYRWMTRYTYWGQGTLVTVSS

SEQ ID NO: 563 - protein, 117 aa, Artificial Sequence
  Description of Artificial Sequence: Synthetic polypeptide
EVQLVESGGGLVQPGGSLTLSCAASGSSVHFLSMAWYRQAPGKKRELVAGISRDGSTDYIDSVKGRFTISRDNAKNSVYLQMNSLRAEDTAVYYCYAYRWTTRYRYWGQGTLVTVSS

SEQ ID NO: 564 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTDYIDSVKGRFTISRDNAKNSVYLQMNSLRAEDTAVYYCYAYRWSTRYTYWGQGTLVTVSS

SEQ ID NO: 565 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISRDGSTDYIDSVKGRFTISRDNAKNSVYLQMNSLRAEDTAVYYCYAYRWTTRYTFWGQGTLVTVSS

SEQ ID NO: 566 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTDYIDSVKGRFTISRDNAKNSVYLQMNSLRAEDTAVYYCYAYRWRTRYTYWGQGTLVTVSS

SEQ ID NO: 567 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISTDGSTDYIDSVKGRFTISRDNAKNSVYLQMNSLRAEDTAVYYCYAYRWTTRRTYWGQGTLVTVSS

SEQ ID NO: 568 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTSYIDSVKGRFTISRDNAKNSVYLQMNSLRAEDTAVYYCYAYRWATRYTYWGQGTLVTVSS

SEQ ID NO: 569 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTLYIDSVKGRFTISRDNAKNSVYLQMNSLRAEDTAVYYCYAYRWHTRYTYWGQGTLVTVSS

SEQ ID NO: 570 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTDYIDSVKGRFTISRDNAKNSVYLQMNSLRAEDTAVYYCYAYRWGTRYTYWGQGTLVTVSS

SEQ ID NO: 571 - protein, 117 aa, Artificial Sequence
  Description of Artificial Sequence: Synthetic polypeptide
EVQLVESGGGLVQPGGSLTLSCAASYSSVSRLSMAWYRQAPGKKRELVAGISADGSTVYIDSVKGRFTISRDNAKNSVYLQMNSLRAEDTAVYYCYAYRWTTRNTYWGQGTLVTVSS

SEQ ID NO: 572 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISTDGSTDYIDSVKGRFTISRDNAKNSVYLQMNSLRAEDTAVYYCYAYRWRTRYTYWGQGTLVTVSS

SEQ ID NO: 573 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTLYIDSVKGRFTISRDNAKNSVYLQMNSLRAEDTAVYYCYAYRWTTRYAYWGQGTLVTVSS

SEQ ID NO: 574 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGRTDYIDSVKGRFTISRDNAKNSVYLQMNSLRAEDTAVYYCYAYRWRTRYTYWGQGTLVTVSS

SEQ ID NO: 575 - protein, 117 aa, Artificial Sequence
  Description of Artificial Sequence: Synthetic polypeptide
EVQLVESGGGLVQPGGSLTLSCVASGTSVSFLSMAWYRQAPGKKRELVAGISADGSTIYIDSVKGRFTISRDNAKNSVYLQMNSLRAEDTAVYYCYAYRWTTRRTYWGQGTLVTVSS

SEQ ID NO: 576 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTLYIDSVKGRFTISRDNAKNSVYLQMNSLRAEDTAVYYCYAYRWTTRRTYWGQGTLVTVSS

SEQ ID NO: 577 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISRDGSTDYIDSVKGRFTISRDNAKNSVYLQMNSLRAEDTAVYYCYAYRWTSRYTYWGQGTLVTVSS

SEQ ID NO: 578 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISKDGSTDYIDSVKGRFTISRDNAKNSVYLQMNSLRAEDTAVYYCYAYRWTTRVTYWGQGTLVTVSS

SEQ ID NO: 579 - protein, 117 aa, Artificial Sequence
  Description of Artificial Sequence: Synthetic polypeptide
EVQLVESGGGLVQPGGSLTLSCAASGSSVSVLSMAWYRQAPGKKRELVAGISADGSTDYIGSVKGRFTISRDNAKNSVYLQMNSLRAEDTAVYYCYAYRWTTRTTYWGQGTLVTVSS

SEQ ID NO: 580 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISVDGSTDYIDSVKGRFTISRDNAKNSVYLQMNSLRAEDTAVYYCYAYRWRTRYTYWGQGTLVTVSS

SEQ ID NO: 581 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTGYIDSVKGRFTISRDNAKNSVYLQMNSLRAEDTAVYYCYAYRWATRYTYWGQGTLVTVSS

SEQ ID NO: 582 - protein, 117 aa, Artificial Sequence
  Description of Artificial Sequence: Synthetic polypeptide
EVQLVESGGGLVQPGGSLTLSCVASGSSVKFLSMAWYRQAPGKKRELVAGISGDGSTTYIDSVKGRFTISRDNAKNSVYLQMNSLRAEDTAVYYCYAYRWTTRRTYWGQGTLVTVSS

SEQ ID NO: 583 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISTDGSTDYIDSVKGRFTISRDNAKNSVYLQMNSLRAEDTAVYYCYALRWTTRYTYWGQGTLVTVSS

SEQ ID NO: 584 - protein, 117 aa, Artificial Sequence
  Description of Artificial Sequence: Synthetic polypeptide
EVQLVESGGGLVQPGGSLTLSCAASGSSVSQLSMAWYRQAPGKKRELVAGISADGSTDYFDSVKGRFTISRDNAKNSVYLQMNSLRAEDTAVYYCYAYRWTTRGTYWGQGTLVTVSS

SEQ ID NO: 585 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTSYIDSVKGRFTISRDNAKNSVYLQMNSLRAEDTAVYYCYAYRWRTRYTYWGQGTLVTVSS

SEQ ID NO: 586 - protein, 117 aa, Artificial Sequence
  Description of Artificial Sequence: Synthetic polypeptide
EVQLVESGGGLVQPGGSLTLSCAASKSSVSFLSMAWYRQAPGKKRELVAGISADGSTDYIDSVKGRFTISRDNAKNSVYLQMNSLRAEDTAVYYCYAYRWTTRATYWGQGTLVTVSS

SEQ ID NO: 587 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTAYIDSVKGRFTISRDNAKNSVYLQMNSLRAEDTAVYYCYAYRWTTRRTYWGQGTLVTVSS

SEQ ID NO: 588 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTVYIDSVKGRFTISRDNAKNSVYLQMNSLRAEDTAVYYCYAYRWPTRYTYWGQGTLVTVSS

SEQ ID NO: 589 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISQDGSTDYIDSVKGRFTISRDNAKNSVYLQMNSLRAEDTAVYYCYAYRWRTRYTYWGQGTLVTVSS

SEQ ID NO: 590 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISNDGSTDYIDSVKGRFTISRDNAKNSVYLQMNSLRAEDTAVYYCYAYRWKTRYTYWGQGTLVTVSS

SEQ ID NO: 591 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISARGSTDYIDSVKGRFTISRDNAKNSVYLQMNSLRAEDTAVYYCYAYRWSTRYTYWGQGTLVTVSS

SEQ ID NO: 592 - protein, 117 aa, Artificial Sequence
  Description of Artificial Sequence: Synthetic polypeptide
EVQLVESGGGLVQPGGSLTLSCAASGSSVSFLSLAWYRQAPGKKRELVAGISADGSTDYIDSVKGRFTISRDNAKNSVYLQMNSLRAEDTAVYYCYAYRWKTRRTYWGQGTLVTVSS

SEQ ID NO: 593 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISRDGSTDYIDSVKGRFTISRDNAKNSVYLQMNSLRAEDTAVYYCYAYRWTTRRTYWGQGTLVTVSS

SEQ ID NO: 594 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSTLYIDSVKGRFTISRDNAKNSVYLQMNSLRAEDTAVYYCYAYRWTTRYRYWGQGTLVTVSS

SEQ ID NO: 595 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTNYIDSVKGRFTISRDNAKNSVYLQMNSLRAEDTAVYYCYAYRWRTRYTYWGQGTLVTVSS

SEQ ID NO: 596 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTVYIDSVKGRFTISRDNAKNSVYLQMNSLRAEDTAVYYCYAYRWTTRYKYWGQGTLVTVSS

SEQ ID NO: 597 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSTTYIDSVKGRFTISRDNAKNSVYLQMNSLRAEDTAVYYCYAYRWKTRYTYWGQGTLVTVSS

SEQ ID NO: 598 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYIGSVKGRFTISRDNAKNSVYLQMNSLRAEDTAVYYCYAYRWTTRVTYWGQGTLVTVSS

SEQ ID NO: 599 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISRDGSTDYIDSVKGRFTISRDNAKNSVYLQMNSLRAEDTAVYYCYAYRWTTRFTYWGQGTLVTVSS

SEQ ID NO: 600 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTTYIDSVKGRFTISRDNAKNSVYLQMNSLRAEDTAVYYCYAYRWTTRFTYWGQGTLVTVSS

SEQ ID NO: 601 - protein, 117 aa, Artificial Sequence
  Description of Artificial Sequence: Synthetic polypeptide
EVQLVESGGGLVQPGGSLTLSCAASGSSVLFLSMAWYRQAPGKKRELVAGVSSDGSTDYIDSVKGRFTISRDNAKNSVYLQMNSLRAEDTAVYYCYAYRWRTRYTYWGQGTLVTVSS

SEQ ID NO: 602 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGHTDYIDSVKGRFTISRDNAKNSVYLQMNSLRAEDTAVYYCYAYRWTTRYTHWGQGTLVTVSS

SEQ ID NO: 603 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTDYFDSVKGRFTISRDNAKNSVYLQMNSLRAEDTAVYYCYAYRWTRRYTYWGQGTLVTVSS

SEQ ID NO: 604 - protein, 117 aa, Artificial Sequence
  Description of Artificial Sequence: Synthetic polypeptide
EVQLVESGGGLVQPGGSLTLSCAASGSSVGFLSMAWYRQAPGKKRELVAGISADGSTVYIDSVKGRFTISRDNAKNSVYLQMNSLRAEDTAVYYCYAYRWTTRYTYWGQGTLVTVSS

SEQ ID NO: 605 - protein, 117 aa, Artificial Sequence
  Description of Artificial Sequence: Synthetic polypeptide
EVQLVESGGGLVQPGGSLTLSCAASGSSVSFMSMAWYRQAPGKKRELVAGISADGSTDYIASVKGRFTISRDNAKNSVYLQMNSLRAEDTAVYYCYAYRWTTRSTYWGQGTLVTVSS

SEQ ID NO: 606 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTDYISSVKGRFTISRDNAKNSVYLQMNSLRAEDTAVYYCYAYSWTTRYTYWGQGTLVTVSS

SEQ ID NO: 607 - protein, 117 aa, Artificial Sequence
  Description of Artificial Sequence: Synthetic polypeptide
EVQLVESGGGLVQPGGSLTLSCAASGSSVTFLSMAWYRQAPGKKRELVAGISADGSTVYIDSVKGRFTISRDNAKNSVYLQMNSLRAEDTAVYYCYAYRWTTRGTYWGQGTLVTVSS

SEQ ID NO: 608 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTVYIDSVKGRFTISRDNAKNSVYLQMNSLRAEDTAVYYCYAYRWKTRYTYWGQGTLVTVSS

SEQ ID NO: 609 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSTTYIDSVKGRFTISRDNAKNSVYLQMNSLRAEDTAVYYCYAYRWTTRFTYWGQGTLVTVSS

SEQ ID NO: 610 - protein, 117 aa, Artificial Sequence
  Description of Artificial Sequence: Synthetic polypeptide
EVQLVESGGGLVQPGGSLTLSCAASGSKVSFMSMAWYRQAPGKKRELVAGISVDGSTDYIDSVKGRFTISRDNAKNSVYLQMNSLRAEDTAVYYCYAYRWRTRYTYWGQGTLVTVSS

SEQ ID NO: 611 - protein, 117 aa, Artificial Sequence
  Description of Artificial Sequence: Synthetic polypeptide
EVQLVESGGGLVQPGGSLTLSCAASGSSVSNLSMAWYRQAPGKKRELVAGISADGSTAYIDSVKGRFTISRDNAKNSVYLQMNSLRAEDTAVYYCYAYRWTTRRTYWGQGTLVTVSS

SEQ ID NO: 612 - protein, 117 aa, Artificial Sequence
  Description of Artificial Sequence: Synthetic polypeptide
EVQLVESGGGLVQPGGSLTLSCAASNSSVSKLSMAWYRQAPGKKRELVAGISADGSTAYIDSVKGRFTISRDNAKNSVYLQMNSLRAEDTAVYYCYAYRWSTRYTYWGQGTLVTVSS

SEQ ID NO: 613 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSKDYIDSVKGRFTISRDNAKNSVYLQMNSLRAEDTAVYYCYAYRWTTRLTYWGQGTLVTVSS

SEQ ID NO: 614 - protein, 117 aa, Artificial Sequence
  Description of Artificial Sequence: Synthetic polypeptide
EVQLVESGGGLVQPGGSLTLSCVASGSQVSFLSMAWYRQAPGKKRELVAGISADGSTDYFDSVKGRFTISRDNAKNSVYLQMNSLRAEDTAVYYCYAYRWTRRYTYWGQGTLVTVSS

SEQ ID NO: 615 - protein, 117 aa, Artificial Sequence
  Description of Artificial Sequence: Synthetic polypeptide
EVQLVESGGGLVQPGGSLTLSCAASGSKVSFMSMAWYRQAPGKKRELVAGISADGSTDYIDSVKGRFTISRDNAKNSVYLQMNSLRAEDTAVYYCYAYRWTTRLTYWGQGTLVTVSS

SEQ ID NO: 616 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTVYIDSVKGRFTISRDNAKNSVYLQMNSLRAEDTAVYYCYAYRWTRRYTYWGQGTLVTVSS

SEQ ID NO: 617 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTVYIDSVKGRFTISRDNAKNSVYLQMNSLRAEDTAVYYCYAYRWTTRRTYWGQGTLVTVSS

SEQ ID NO: 618 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISARGSTDYIDSVKGRFTISRDNAKNSVYLQMNSLRAEDTAVYYCYAYQWTTRYTYWGQGTLVTVSS

SEQ ID NO: 619 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISATGSTDYIDSVKGRFTISRDNAKNSVYLQMNSLRAEDTAVYYCYAYRWTRRYTYWGQGTLVTVSS

SEQ ID NO: 620 - protein, 117 aa, Artificial Sequence
  Description of Artificial Sequence: Synthetic polypeptide
EVQLVESGGGLVQPGGSLTLSCAASGSSVSFLSIAWYRQAPGKKRELVAGISKDGSTDYIDSVKGRFTISRDNAKNSVYLQMNSLRAEDTAVYYCYAYRWTTRMTYWGQGTLVTVSS

SEQ ID NO: 621 - protein, 117 aa, Artificial Sequence
  Description of Artificial Sequence: Synthetic polypeptide
EVQLVESGGGLVQPGGSLTLSCAASGSSSSFLSMAWYRQAPGKKRELVAGISADGSTVYIDSVKGRFTISRDNAKNSVYLQMNSLRAEDTAVYYCYAYRWTTRRTYWGQGTLVTVSS

SEQ ID NO: 622 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISPDGSTDYIDSVKGRFTISRDNAKNSVYLQMNSLRAEDTAVYYCYAYRWTTRYRYWGQGTLVTVSS

SEQ ID NO: 623 - protein, 117 aa, Artificial Sequence
  Description of Artificial Sequence: Synthetic polypeptide
EVQLVESGGGLVQPGGSLTLSCAASGSSVNFLSMAWYRQAPGKKRELVAGISADGSTHYIDSVKGRFTISRDNAKNSVYLQMNSLRAEDTAVYYCYAYRWLTRYTYWGQGTLVTVSS

SEQ ID NO: 624 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYILSVKGRFTISRDNAKNSVYLQMNSLRAEDTAVYYCYAYEWTTRYTYWGQGTLVTVSS

SEQ ID NO: 625 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISADGSTDYIHSVKGRFTISRDNAKNSVYLQMNSLRAEDTAVYYCYAYRWRTRYTYWGQGTLVTVSS

SEQ ID NO: 626 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISVDGSTDYIDSVKGRFTISRDNAKNSVYLQMNSLRAEDTAVYYCYAYRWRTRYTYWGQGTLVTVSS

SEQ ID NO: 627 - protein, 117 aa, Artificial Sequence
  Description of Artificial Sequence: Synthetic polypeptide
EVQLVESGGGLVQPGGSLTLSCAASGSSVSFLSVAWYRQAPGKKRELVAGISRDGSTDYIDSVKGRFTISRDNAKNSVYLQMNSLRAEDTAVYYCYAYRWRTRYTYWGQGTLVTVSS

SEQ ID NO: 628 - protein, 117 aa, Artificial Sequence
  Description of Artificial Sequence: Synthetic polypeptide
EVQLVESGGGLVQPGGSLTLSCAASGSQVSFLSMAWYRQAPGKKRELVAGISADGSTVYIDSVKGRFTISRDNAKNSVYLQMNSLRAEDTAVYYCYAYRWSTRYTYWGQGTLVTVSS

SEQ ID NO: 629 - protein, 117 aa, Artificial Sequence
  Description of Artificial Sequence: Synthetic polypeptide
EVQLVESGGGLVQPGGSLTLSCAASGTSVSFLSMAWYRQAPGKKRELVAGISADGSTDYIRSVKGRFTISRDNAKNSVYLQMNSLRAEDTAVYYCYAYRWTTRLTYWGQGTLVTVSS

SEQ ID NO: 630 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTMYIDSVKGRFTISRDNAKNSVYLQMNSLRAEDTAVYYCYAYRWTTRLTYWGQGTLVTVSS

SEQ ID NO: 631 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISTDGSTDYIDSVKGRFTISRDNAKNSVYLQMNSLRAEDTAVYYCYAYKWTTRYTYWGQGTLVTVSS

SEQ ID NO: 632 - protein, 117 aa, Artificial Sequence
  Description of Artificial Sequence: Synthetic polypeptide
EVQLVESGGGLVQPGGSLTLSCAASGSSVSFLSSAWYRQAPGKKRELVAGISADGSTLYIDSVKGRFTISRDNAKNSVYLQMNSLRAEDTAVYYCYAYRWTTRSTYWGQGTLVTVSS

SEQ ID NO: 633 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYIDSVKGRFTISRDNAKNSVYLQMNSLRAEDTAVYYCYAYRWRTRYTYWGQGTLVTVSS

SEQ ID NO: 634 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISATGSTDYIDSVKGRFTISRDNAKNSVYLQMNSLRAEDTAVYYCYAYRWSTRYTYWGQGTLVTVSS

SEQ ID NO: 635 - protein, 117 aa, Artificial Sequence
  Description of Artificial Sequence: Synthetic polypeptide
EVQLVESGGGLVQPGGSLTLSCAASGSTVSFLSMAWYRQAPGKKRELVAGISHDGSTDYIDSVKGRFTISRDNAKNSVYLQMNSLRAEDTAVYYCYAYRWTTRYTYWGQGTLVTVSS

SEQ ID NO: 636 - protein, 117 aa, Artificial Sequence
  Description of Artificial Sequence: Synthetic polypeptide
EVQLVESGGGLVQPGGSLTLSCAASGSSVQFLSMAWYRQAPGKKRELVAGISYDGSTDYIDSVKGRFTISRDNAKNSVYLQMNSLRAEDTAVYYCYAYRWRTRYTYWGQGTLVTVSS

SEQ ID NO: 637 - protein, 117 aa, Artificial Sequence
  Description of Artificial Sequence: Synthetic polypeptide
EVQLVESGGGLVQPGGSLTLSCAASRSSVSFLSMAWYRQAPGKKRELVAGISTDGSTDYIDSVKGRFTISRDNAKNSVYLQMNSLRAEDTAVYYCYAYRWLTRYTYWGQGTLVTVSS

SEQ ID NO: 638 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSTAYIDSVKGRFTISRDNAKNSVYLQMNSLRAEDTAVYYCYAYRWRTRYTYWGQGTLVTVSS

SEQ ID NO: 639 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTDYIESVKGRFTISRDNAKNSVYLQMNSLRAEDTAVYYCYAYRWTTRYTYWGQGTLVTVSS

SEQ ID NO: 640 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISIDGSTDYIKSVKGRFTISRDNAKNSVYLQMNSLRAEDTAVYYCYAYRWTTRYRYWGQGTLVTVSS

SEQ ID NO: 641 - protein, 117 aa, Artificial Sequence
  Description of Artificial Sequence: Synthetic polypeptide
EVQLVESGGGLVQPGGSLTLSCAASGSKVSFLSMAWYRQAPGKKRELVAGISADGSKDYIDSVKGRFTISRDNAKNSVYLQMNSLRAEDTAVYYCYAYRWTTRYTYWGQGTLVTVSS

SEQ ID NO: 642 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTVYIDSVKGRFTISRDNAKNSVYLQMNSLRAEDTAVYYCYAYRWPTRYTYWGQGTLVTVSS

SEQ ID NO: 643 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISRDGSTDYIDSVKGRFTISRDNAKNSVYLQMNSLRAEDTAVYYCYAYRWTTRHTYWGQGTLVTVSS

SEQ ID NO: 644 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYIHSVKGRFTISRDNAKNSVYLQMNSLRAEDTAVYYCYAYRWTRRYTYWGQGTLVTVSS

SEQ ID NO: 645 - protein, 117 aa, Artificial Sequence
  Description of Artificial Sequence: Synthetic polypeptide
EVQLVESGGGLVQPGGSLTLSCAASGSSVSILSMAWYRQAPGKKRELVAGISADGSTIYIDSVKGRFTISRDNAKNSVYLQMNSLRAEDTAVYYCYAYRWHTRYTYWGQGTLVTVSS

SEQ ID NO: 646 - protein, 117 aa, Artificial Sequence
  Description of Artificial Sequence: Synthetic polypeptide
EVQLVESGGGLVQPGGSLTLSCAASGSSVSFLSVAWYRQAPGKKRELVAGISANGSTDYIDSVKGRFTISRDNAKNSVYLQMNSLRAEDTAVYYCYAYRWTNRYTYWGQGTLVTVSS

SEQ ID NO: 647 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISTDGSTDYIDSVKGRFTISRDNAKNSVYLQMNSLRAEDTAVYYCYAYRWTTRYRYWGQGTLVTVSS

SEQ ID NO: 648 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISYDGSTDYIDSVKGRFTISRDNAKNSVYLQMNSLRAEDTAVYYCYAYRWTTRRTYWGQGTLVTVSS

SEQ ID NO: 649 - protein, 117 aa, Artificial Sequence
  Description of Artificial Sequence: Synthetic polypeptide
EVQLVESGGGLVQPGGSLTLSCAASGHSVSFLSMAWYRQAPGKKRELVAGISADGSTDYIASVKGRFTISRDNAKNSVYLQMNSLRAEDTAVYYCYAYRWSTRYTYWGQGTLVTVSS

SEQ ID NO: 650 - protein, 117 aa, Artificial Sequence
  Description of Artificial Sequence: Synthetic polypeptide
EVQLVESGGGLVQPGGSLTLSCAASGSSVRFLSMAWYRQAPGKKRELVAGISADGSTDYIGSVKGRFTISRDNAKNSVYLQMNSLRAEDTAVYYCYAYRWSTRYTYWGQGTLVTVSS

SEQ ID NO: 651 - protein, 117 aa, Artificial Sequence
  Description of Artificial Sequence: Synthetic polypeptide
EVQLVESGGGLVQPGGSLTLSCAASGSSVSFLSMAWYRQAPGKKRELVAGISANGSTDYYDSVKGRFTISRDNAKNSVYLQMNSLRAEDTAVYYCYAYRWRTRYTYWGQGTLVTVSS

SEQ ID NO: 652 - protein, 117 aa, Artificial Sequence
  Description of Artificial Sequence: Synthetic polypeptide
EVQLVESGGGLVQPGGSLTLSCAASGSRVSFLSMAWYRQAPGKKRELVAGISADGSTSYIDSVKGRFTISRDNAKNSVYLQMNSLRAEDTAVYYCYAYRWTTRYTYWGQGTLVTVSS

SEQ ID NO: 653 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGVSADGSTDYIDSVKGRFTISRDNAKNSVYLQMNSLRAEDTAVYYCYAYEWTTRYTYWGQGTLVTVSS

SEQ ID NO: 654 - protein, 117 aa, Artificial Sequence
  Description of Artificial Sequence: Synthetic polypeptide
EVQLVESGGGLVQPGGSLTLSCAASGSSVSRLSMAWYRQAPGKKRELVAGISARGSTDYIDSVKGRFTISRDNAKNSVYLQMNSLRAEDTAVYYCYAYRWTTRSTYWGQGTLVTVSS

SEQ ID NO: 655 - protein, 117 aa, Artificial Sequence
  Description of Artificial Sequence: Synthetic polypeptide
EVQLVESGGGLVQPGGSLTLSCAASGRSVSFLSMAWYRQAPGKKRELVAGISADGSTIYIDSVKGRFTISRDNAKNSVYLQMNSLRAEDTAVYYCYAYRWTTRYTYWGQGTLVTVSS

SEQ ID NO: 656 - protein, 117 aa, Artificial Sequence
  Description of Artificial Sequence: Synthetic polypeptide
EVQLVESGGGLVQPGGSLTLSCAASGRSVSFLSMAWYRQAPGKKRELVAGISANGSTDYIDSVKGRFTISRDNAKNSVYLQMNSLRAEDTAVYYCYAYRWSTRYTYWGQGTLVTVSS

SEQ ID NO: 657 - protein, 117 aa, Artificial Sequence
  Description of Artificial Sequence: Synthetic polypeptide
EVQLVESGGGLVQPGGSLTLSCAASGSSVKFLSMAWYRQAPGKKRELVAGISADGSTDYVDSVKGRFTISRDNAKNSVYLQMNSLRAEDTAVYYCYAYRWSTRYTYWGQGTLVTVSS

SEQ ID NO: 658 - protein, 117 aa, Artificial Sequence
  Description of Artificial Sequence: Synthetic polypeptide
EVQLVESGGGLVQPGGSLTLSCAASGSSVSKLSMAWYRQAPGKKRELVAGISADGSTDYRDSVKGRFTISRDNAKNSVYLQMNSLRAEDTAVYYCYAYRWTYRYTYWGQGTLVTVSS

SEQ ID NO: 659 - protein, 117 aa, Artificial Sequence
  Description of Artificial Sequence: Synthetic polypeptide
EVQLVESGGGLVQPGGSLTLSCAASGSSVSRLSMAWYRQAPGKKRELVAGISVDGSTDYIDSVKGRFTISRDNAKNSVYLQMNSLRAEDTAVYYCYAYRWTTRLTYWGQGTLVTVSS

SEQ ID NO: 660 - protein, 117 aa, Artificial Sequence
  Description of Artificial Sequence: Synthetic polypeptide
EVQLVESGGGLVQPGGSLTLSCAASGSSVKFLSLAWYRQAPGKKRELVAGISADGSTDYILSVKGRFTISRDNAKNSVYLQMNSLRAEDTAVYYCYAYEWTTRYTYWGQGTLVTVSS

SEQ ID NO: 661 - protein, 117 aa, Artificial Sequence
  Description of Artificial Sequence: Synthetic polypeptide
EVQLVESGGGLVQPGGSLTLSCAASGSSVSRLSLAWYRQAPGKKRELVAGISVDGSTDYIDSVKGRFTISRDNAKNSVYLQMNSLRAEDTAVYYCYAYRWTTRLTYWGQGTLVTVSS

SEQ ID NO: 662 - protein, 119 aa, Artificial Sequence
  Description of Artificial Sequence: Synthetic polypeptide
EVQLVESGGGLVQPGGSLTLSCVASGTSSSINAMGWYRRAPGKQRELVAGISSDGSKVFNESVKGRFTISRDNAKNSVYLQMNSLRAEDTAVYYCYYFRPAAGSPMRYWGQGTLVTVSS

SEQ ID NO: 663 - protein, 119 aa, Artificial Sequence
  Description of Artificial Sequence: Synthetic polypeptide
EVQLVESGGGLVQPGGSLTLSCVASGTTSSINAIGWYRRAPGKQRELVAGISSDGSEVYTDSVKGRFTISRDNAKNSVYLQMNSLRAEDTAVYYCYYFRTVDGSPLRYWGQGTLVTVSS

SEQ ID NO: 664 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDDSNVYYESVKGRFTISRDNAKNSVYLQMNSLRAEDTAVYYCYYFRTVSGSSKRYWGQGTLVTVSS

SEQ ID NO: 665 - protein, 119 aa, Artificial Sequence
  Description of Artificial Sequence: Synthetic polypeptide
EVQLVESGGGLVQPGGSLTLSCVASGQTYRVNAFGWYRRAPGKQRELVAGISSDGSKVYADSVKGRFTISRDNAKNSVYLQMNSLRAEDTAVYYCYYFSAGSGTEMSYWGQGTLVTVSS

SEQ ID NO: 666 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDESTLYVDSVKGRFTISRDNAKNSVYLQMNSLRAEDTAVYYCYYFGSLSGSSTTYWGQGTLVTVSS

SEQ ID NO: 667 - protein, 119 aa, Artificial Sequence
  Description of Artificial Sequence: Synthetic polypeptide
EVQLVESGGGLVQPGGSLTLSCVASGSASLTNATGWYRRAPGKQRELVAGISSDDSKVYSDSVKGRFTISRDNAKNSVYLQMNSLRAEDTAVYYCYYFGSVSGSWTRYWGQGTLVTVSS

SEQ ID NO: 668 - protein, 119 aa, Artificial Sequence
  Description of Artificial Sequence: Synthetic polypeptide
EVQLVESGGGLVQPGGSLTLSCVASGYPSLNNAMGWYRRAPGKQRELVAGISSDGSQVYGASVKGRFTISRDNAKNSVYLQMNSLRAEDTAVYYCYYFRLVSGSSMSYWGQGTLVTVSS

SEQ ID NO: 669 - protein, 119 aa, Artificial Sequence
  Description of Artificial Sequence: Synthetic polypeptide
EVQLVESGGGLVQPGGSLTLSCVASGSSSTINAIGWYRRAPGKQRELVAGISSDGSKVYADSVKGRFTISRDNAKNSVYLQMNSLRAEDTAVYYCYYFRTGSGTSKSYWGQGTLVTVSS

SEQ ID NO: 670 - protein, 119 aa, Artificial Sequence
  Description of Artificial Sequence: Synthetic polypeptide
EVQLVESGGGLVQPGGSLTLSCVASGSTSYINAMGWYRRAPGKQRELVAGISSDGSNMYADSVKGRFTISRDNAKNSVYLQMNSLRAEDTAVYYCYYFSNMSGTTRRYWGQGTLVTVSS

SEQ ID NO: 671 - protein, 119 aa, Artificial Sequence
  Description of Artificial Sequence: Synthetic polypeptide
EVQLVESGGGLVQPGGSLTLSCVASGSTSSVNALGWYRRAPGKQRELVAGISSDGSKVYTDSVKGRFTISRDNAKNSVYLQMNSLRAEDTAVYYCYYFRTVPGSAMGYWGQGTLVTVSS

SEQ ID NO: 672 - protein, 119 aa, Artificial Sequence
  Description of Artificial Sequence: Synthetic polypeptide
EVQLVESGGGLVQPGGSLTLSCVASGSTSLSNAVGWYRRAPGKQRELVAGISSDGSKVSAESVKGRFTISRDNAKNSVYLQMNSLRAEDTAVYYCYYFRAESGSSMGYWGQGTLVTVSS

SEQ ID NO: 673 - protein, 119 aa, Artificial Sequence
  Description of Artificial Sequence: Synthetic polypeptide
EVQLVESGGGLVQPGGSLTLSCVASGSTSSTNAIGWYRRAPGKQRELVAGISSDGSKVYDDSVKGRFTISRDNAKNSVYLQMNSLRAEDTAVYYCYYFRTLYGSSRSYWGQGTLVTVSS

SEQ ID NO: 674 - protein, 119 aa, Artificial Sequence
  Description of Artificial Sequence: Synthetic polypeptide
EVQLVESGGGLVQPGGSLTLSCVASGLTSTINAMGWYRRAPGKQRELVAGISSDGSKVYDDSVKGRFTISRDNAKNSVYLQMNSLRAEDTAVYYCYYFSPFSGSDTGYWGQGTLVTVSS

SEQ ID NO: 675 - protein, 119 aa, Artificial Sequence
  Description of Artificial Sequence: Synthetic polypeptide
EVQLVESGGGLVQPGGSLTLSCVASGVSPSKNAIGWYRRAPGKQRELVAGISSDGSAVYVGSVKGRFTISRDNAKNSVYLQMNSLRAEDTAVYYCYYFSTFSGSSISYWGQGTLVTVSS

SEQ ID NO: 676 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSYVYSESVKGRFTISRDNAKNSVYLQMNSLRAEDTAVYYCYYFRTLAGSEMRYWGQGTLVTVSS

SEQ ID NO: 677 - protein, 119 aa, Artificial Sequence
  Description of Artificial Sequence: Synthetic polypeptide
EVQLVESGGGLVQPGGSLTLSCVASGSTTMNNAMAWYRRAPGKQRELVAGISSDSSHVYADSVKGRFTISRDNAKNSVYLQMNSLRAEDTAVYYCYYFRTVSGSGVRYWGQGTLVTVSS

SEQ ID NO: 678 - protein, 119 aa, Artificial Sequence
  Description of Artificial Sequence: Synthetic polypeptide
EVQLVESGGGLVQPGGSLTLSCVASGSTSKINAIGWYRRAPGKQRELVAGISSDSSIVYTDSVKGRFTISRDNAKNSVYLQMNSLRAEDTAVYYCYYFRPGAGHSNSYWGQGTLVTVSS

SEQ ID NO: 679 - protein, 119 aa, Artificial Sequence
  Description of Artificial Sequence: Synthetic polypeptide
EVQLVESGGGLVQPGGSLTLSCVASGQTTALNAMGWYRRAPGKQRELVAGISSDGSEVNTDSVKGRFTISRDNAKNSVYLQMNSLRAEDTAVYYCYYFRRASGTAMSYWGQGTLVTVSS

SEQ ID NO: 680 - protein, 119 aa, Artificial Sequence
  Description of Artificial Sequence: Synthetic polypeptide
EVQLVESGGGLVQPGGSLTLSCVASGATSSINAIGWYRRAPGKQRELVAGISSDGSKLSSDSVKGRFTISRDNAKNSVYLQMNSLRAEDTAVYYCYYFTSASGTDLSYWGQGTLVTVSS

SEQ ID NO: 681 - protein, 119 aa, Artificial Sequence
  Description of Artificial Sequence: Synthetic polypeptide
EVQLVESGGGLVQPGGSLTLSCVASGSTSTINAMGWYRRAPGKQRELVAGISSDNSKVYADSVKGRFTISRDNAKNSVYLQMNSLRAEDTAVYYCYYFRSANGSSKRYWGQGTLVTVSS

SEQ ID NO: 682 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDGSRVYFDSVKGRFTISRDNAKNSVYLQMNSLRAEDTAVYYCYYFKTIAGAGMRYWGQGTLVTVSS

SEQ ID NO: 683 - protein, 119 aa, Artificial Sequence
  Description of Artificial Sequence: Synthetic polypeptide
EVQLVESGGGLVQPGGSLTLSCVASGSTSLVNAMGWYRRAPGKQRELVAGISSDGSLVYAESVKGRFTISRDNAKNSVYLQMNSLRAEDTAVYYCYYFRYGSGSSLSYWGQGTLVTVSS

SEQ ID NO: 684 - protein, 119 aa, Artificial Sequence
  Description of Artificial Sequence: Synthetic polypeptide
EVQLVESGGGLVQPGGSLTLSCVASGSTSLNNAIGWYRRAPGKQRELVAGISSDGSVVYVDSVKGRFTISRDNAKNSVYLQMNSLRAEDTAVYYCYYFRTVPGASMKYWGQGTLVTVSS

SEQ ID NO: 685 - protein, 119 aa, Artificial Sequence
  Description of Artificial Sequence: Synthetic polypeptide
EVQLVESGGGLVQPGGSLTLSCVASGSTSPVNAMAWYRRAPGKQRELVAGISSDGSKVYVDSVKGRFTISRDNAKNSVYLQMNSLRAEDTAVYYCYYFRTVDGSAISYWGQGTLVTVSS

SEQ ID NO: 686 - protein, 119 aa, Artificial Sequence
  Description of Artificial Sequence: Synthetic polypeptide
EVQLVESGGGLVQPGGSLTLSCVASGTTSSMNAIGWYRRAPGKQRELVAGISSDGSKLYDESVKGRFTISRDNAKNSVYLQMNSLRAEDTAVYYCYYFRTVKGSGGSYWGQGTLVTVSS

SEQ ID NO: 687 - protein, 119 aa, Artificial Sequence
  Description of Artificial Sequence: Synthetic polypeptide
EVQLVESGGGLVQPGGSLTLSCVASGETSSINAMAWYRRAPGKQRELVAGISSDYSKLYADSVKGRFTISRDNAKNSVYLQMNSLRAEDTAVYYCYYFRTVSGSSRGYWGQGTLVTVSS

SEQ ID NO: 688 - protein, 119 aa, Artificial Sequence
  Description of Artificial Sequence: Synthetic polypeptide
EVQLVESGGGLVQPGGSLTLSCVASGSTSTINAIGWYRRAPGKQRELVAGISSDSSKVYTESVKGRFTISRDNAKNSVYLQMNSLRAEDTAVYYCYYFRPGPGSQMAYWGQGTLVTVSS

SEQ ID NO: 689 - protein, 119 aa, Artificial Sequence
  Description of Artificial Sequence: Synthetic polypeptide
EVQLVESGGGLVQPGGSLTLSCVASGSTYSMNAMGWYRRAPGKQRELVAGISSDGSQVYVDSVKGRFTISRDNAKNSVYLQMNSLRAEDTAVYYCYYFRTVAGSASGYWGQGTLVTVSS

SEQ ID NO: 690 - protein, 119 aa, Artificial Sequence; identical to SEQ ID NO: 521
  Description of Artificial Sequence: Synthetic polypeptide

SEQ ID NO: 691 - protein, 119 aa, Artificial Sequence
  Description of Artificial Sequence: Synthetic polypeptide
EVQLVESGGGLVQPGGSLTLSCVASGSTSTINAIGWYRRAPGKQRELVAGISSDGSKVYVDSVKGRFTISRDNAKNSVYLQMNSLRAEDTAVYYCYYFINLKGSSMAYWGQGTLVTVSS

SEQ ID NO: 692 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDGSKVYADSVKGRFTISRDNAKNSVYLQMNSLRAEDTAVYYCYYFRMVTGSYGGYWGQGTLVTVSS

SEQ ID NO: 693 - protein, 119 aa, Artificial Sequence
  Description of Artificial Sequence: Synthetic polypeptide
EVQLVESGGGLVQPGGSLTLSCVASGSISSINAMGWYRRAPGKQRELVAGISSDGSSVYADSVKGRFTISRDNAKNSVYLQMNSLRAEDTAVYYCYYFKSSYGLPMRYWGQGTLVTVSS

SEQ ID NO: 694 - protein, 119 aa, Artificial Sequence
  Description of Artificial Sequence: Synthetic polypeptide
EVQLVESGGGLVQPGGSLTLSCVASGSTQVNNAMAWYRRAPGKQRELVAGISSDGSQVYYGSVKGRFTISRDNAKNSVYLQMNSLRAEDTAVYYCYYFKTVSGQSLRYWGQGTLVTVSS

SEQ ID NO: 695 - protein, 119 aa, Artificial Sequence
  Description of Artificial Sequence: Synthetic polypeptide
EVQLVESGGGLVQPGGSLTLSCVASGSTASFNAMAWYRRAPGKQRELVAGISSDGSKVYTDSVKGRFTISRDNAKNSVYLQMNSLRAEDTAVYYCYYFRTVTGRAARYWGQGTLVTVSS

SEQ ID NO: 696 - protein, 119 aa, Artificial Sequence
  Description of Artificial Sequence: Synthetic polypeptide
EVQLVESGGGLVQPGGSLTLSCVASGSPLSINAIGWYRRAPGKQRELVAGISSDGSKVSADSVKGRFTISRDNAKNSVYLQMNSLRAEDTAVYYCYYFGPAIGASRTYWGQGTLVTVSS

SEQ ID NO: 697 - protein, 119 aa, Artificial Sequence
  Description of Artificial Sequence: Synthetic polypeptide
EVQLVESGGGLVQPGGSLTLSCVASGSTTFINAIGWYRRAPGKQRELVAGISSDGSKVYEDSVKGRFTISRDNAKNSVYLQMNSLRAEDTAVYYCYYFRTVSGAPKSYWGQGTLVTVSS

SEQ ID NO: 698 - protein, 119 aa, Artificial Sequence
  Description of Artificial Sequence: Synthetic polypeptide
EVQLVESGGGLVQPGGSLTLSCVASGSTSSINAIGWYRRAPGKQRELVAGISSDRSKVYADSVKGRFTISRDNAKNSVYLQMNSLRAEDTAVYYCYYFHTVSGSSMSYWGQGTLVTVSS

SEQ ID NO: 699 - protein, 119 aa, Artificial Sequence
  Description of Artificial Sequence: Synthetic polypeptide
EVQLVESGGGLVQPGGSLTLSCVASGETDTINAVGWYRRAPGKQRELVAGISSDGSKVYAESVKGRFTISRDNAKNSVYLQMNSLRAEDTAVYYCYYFRRLEGYSNRYWGQGTLVTVSS

SEQ ID NO: 700 - protein, 119 aa, Artificial Sequence
  Description of Artificial Sequence: Synthetic polypeptide
EVQLVESGGGLVQPGGSLTLSCVASGSTSPINAIGWYRRAPGKQRELVAGISSDGSVVTTESVKGRFTISRDNAKNSVYLQMNSLRAEDTAVYYCYYFRTGSGSSMGYWGQGTLVTVSS

SEQ ID NO: 701 - protein, 119 aa, Artificial Sequence
  Description of Artificial Sequence: Synthetic polypeptide
EVQLVESGGGLVQPGGSLTLSCVASGSITSSNAMGWYRRAPGKQRELVAGISSDGSHVHQESVKGRFTISRDNAKNSVYLQMNSLRAEDTAVYYCYYFTTVTGSSMSYWGQGTLVTVSS

SEQ ID NO: 702 - protein, 117 aa, Artificial Sequence
  Description of Artificial Sequence: Synthetic polypeptide
EVQLVESGGGLVQPGGSLTLSCAASRYSVSNLSMAWYRQAPGKKRELVAGISADGSTVYVESVKGRFTISRDNAKNSVYLQMNSLRAEDTAVYYCYAYYWTERRPYWGQGTLVTVSS

SEQ ID NO: 703 - protein, 117 aa, Artificial Sequence
  Description of Artificial Sequence: Synthetic polypeptide
EVQLVESGGGLVQPGDSLTLSCAASMSTVSVLSMAWYRQAPGKKRELVAGISSDGSTVYIDSVKGRFTISRDNAKNSVYLQMNSLRAEDTAIYYCYAYSWDDAHPYWGQGTLVTVSS

SEQ ID NO: 704 - protein, 117 aa, Artificial Sequence
  Description of Artificial Sequence: Synthetic polypeptide
EVQLVESGGGLVQPGGSLTLSCAASDSYVSLLSMAWYRQAPGKKRELVAGISVDGSTHYVASVKGRFTISRDNAKNSVYLQMNSLRAEDTAVYYCYAYRWMTRLTYWGQGTLVTVSS

SEQ ID NO: 705 - protein, 117 aa, Artificial Sequence
  Description of Artificial Sequence: Synthetic polypeptide
EVQLVESGGGLVQPGGSLTLSCAASDSAVSVLSIAWYRQAPGKKRELVAGISTDGSKHYIDSVKGRFTISRDNAKNSVYLQMNSLRAEDTAVYYCYAYDWADAQPYWGQGTLVTVSS

SEQ ID NO: 706 - protein, 117 aa, Artificial Sequence
  Description of Artificial Sequence: Synthetic polypeptide
EVQLVESGGGLVQPGGSLTLSCAASHSSVTSLSLAWYRQAPGKKRELVAGISYDGSKYYAESVKGRFTISRDNAKNSVYLQMNSLRAEDTAVYYCYAYSWTDRLPYWGQGTLVTVSS

SEQ ID NO: 707 - protein, 117 aa, Artificial Sequence
  Description of Artificial Sequence: Synthetic polypeptide
EVQLVESGGGLVQPGGSLTLSCAASDSVVKFLSMAWYRQAPGKKRELVAGISANGSRTYMESVKGRFTISRDNAKNSVYLQMNSLRAEDTAVYYCYAYRWATRLPYWGQGTLVTVSS

SEQ ID NO: 708 - protein, 117 aa, Artificial Sequence
  Description of Artificial Sequence: Synthetic polypeptide
EVQLVESGGGLVQPGGSLTLSCAASDPSVWNLSMAWYRQAPGKKRELVAGISPDGSTDYVDSVKGRFTISRDNAKNSVYLQMNSLRAEDTAVYYCYAYKWSNRLPYWGQGTLVTVSS

SEQ ID NO: 709 - protein, 117 aa, Artificial Sequence
  Description of Artificial Sequence: Synthetic polypeptide
EVQLVESGGGLVQPGGSLTLSCAASGTSVMLLSLAWYRQAPGKKRELVAGISPNGSAVYTESVKGRFTISRDNAKNSVYLQMNSLRAEDTAVYYCYAYGWKTRQPYWGQGTLVTVSS

SEQ ID NO: 710 - protein, 117 aa, Artificial Sequence
  Description of Artificial Sequence: Synthetic polypeptide
EVQLVESGGGLVQPGGSLTLSCAASSSPVSNLSLAWYRQAPGKKRELVAGISPDGSTAYMESVKGRFTISRDNAKNSVYLQMNSLRAEDTAVYYCYAYRWPNRRGYWGQGTLVTVSS

SEQ ID NO: 711 - protein, 117 aa, Artificial Sequence
  Description of Artificial Sequence: Synthetic polypeptide
EVQLVESGGGLVQPGGSLTLSCAASWRSVLLLSVAWYRQAPGKKRELVAGISNDGSTDYIDSVKGRFTISRDNAKNSVYLQMNSLRAEDTAVYYCYAYDWTTRQRYWGQGTLVTVSS

SEQ ID NO: 712 - protein, 117 aa, Artificial Sequence
  Description of Artificial Sequence: Synthetic polypeptide
EVQLVESGGGLVQPGGSLTLSCAASSSSVQYLSMAWYRQAPGKKRELVAGISTDGSAVYFDSVKGRFTISRDNAKNSVYLQMNSLRAEDTAVYYCYAYNWSYAQPYWGQGTLVTVSS

SEQ ID NO: 713 - protein, 117 aa, Artificial Sequence
  Description of Artificial Sequence: Synthetic polypeptide
EVQLVESGGGLVQPGGSLTLSCAASGTSVSLLSLAWYRQAPGKKRELVAGISTGGSTHYIESVKGRFTISRDNAKNSVYLQMNSLRAEDTAVYYCYAYNWTDSLQYWGQGTLVTVSS

SEQ ID NO: 714 - protein, 117 aa, Artificial Sequence
  Description of Artificial Sequence: Synthetic polypeptide
EVQLVESGGGLVQPGGSLTLSCAASLSSVSNLSIAWYRQAPGKKRELVAGISTDGSTVYIDSVKGRFTISRDNAKNSVYLQMNSLRAEDTAVYYCYAYSWTTSLPYWGQGTLVTVSS

SEQ ID NO: 715 - protein, 117 aa, Artificial Sequence
  Description of Artificial Sequence: Synthetic polypeptide
EVQLVESGGGLVQPGGSLTLSCAASMYSVSFLSMAWYRQAPGKKRELVAGISNEGSTYYMDSVKGRFTISRDNAKNSVYLQMNSLRAEDTAVYYCYAYKWRSRSTYWGQGTLVTVSS

SEQ ID NO: 716 - protein, 117 aa, Artificial Sequence
  Description of Artificial Sequence: Synthetic polypeptide
EVQLVESGGGLVQPGGSLTLSCAASKSSVSHLSLAWYRQAPGKKRELVAGISADGSHVYTNSVKGRFTISRDNAKNSVYLQMNSLRAEDTAVYYCYAYSQTTRDPYWGQGTLVTVSS

SEQ ID NO: 717 - protein, 117 aa, Artificial Sequence
  Description of Artificial Sequence: Synthetic polypeptide
EVQLVESGGGLVQPGGSLTLSCAASYTSVLDLSIAWYRQAPGKKRELVAGISDDGSRYYTDSVKGRFTISRDNAKNSVYLQMNSLRAEDTAVYYCYAYRWTARDTYWGQGTLVTVSS

SEQ ID NO: 718 - protein, 117 aa, Artificial Sequence
  Description of Artificial Sequence: Synthetic polypeptide
EVQLVESGGGLVQPGGSLTLSCAASMSDVSFLSMAWYRQAPGKKRELVAGISAEGSTLYMESVKGRFTISRDNAKNSVYLQMNSLRAEDTAVYYCYAYRWTSRLSYWGQGTLVTVSS

SEQ ID NO: 719 - protein, 117 aa, Artificial Sequence
  Description of Artificial Sequence: Synthetic polypeptide
EVQLVESGGGLVQPGGSLTLSCAASESSVSFLSSAWYRQAPGKKRELVAGISTDGSTVYIDSVKGRFTISRDNAKNSVYLQMNSLRAEDTAVYYCYAYSWTTRSRYWGQGTLVTVSS

SEQ ID NO: 720 - protein, 117 aa, Artificial Sequence
  Description of Artificial Sequence: Synthetic polypeptide
EVQLVESGGGLVQPGGSLTLSCAASGDSVSLLSMAWYRQAPGKKRELVAGISANGSTSYIDSVKGRFTISRDNAKNSVYLQMNSLRAEDTAVYYCYAYNWTSRYRYWGQGTLVTVSS

SEQ ID NO: 721 - protein, 117 aa, Artificial Sequence
  Description of Artificial Sequence: Synthetic polypeptide
EVQLVESGGGLVQPGGSLTLSCAASGSDVWYLSLAWYRQAPGKKRELVAGISDDGSRHYIESVKGRFTISRDNAKNSVYLQMNSLRAEDTAVYYCYAYSWKTRFPYWGQGTLVTVSS

SEQ ID NO: 722 - protein, 117 aa, Artificial Sequence
  Description of Artificial Sequence: Synthetic polypeptide
EVQLVESGGGLVQPGGSLTLSCAASKSAVAFLSIAWYRQAPGKKRELVAGISPDGSTVYIESVKGRFTISRDNAKNSVYLQMNSLRAEDTAVYYCYAYSWTTRYPYWGQGTLVTVSS

SEQ ID NO: 723 - protein, 117 aa, Artificial Sequence
  Description of Artificial Sequence: Synthetic polypeptide
EVQLVESGGGLVQPGGSLTLSCAASFSAVAYLSMAWYRQAPGKKRELVAGISDDGSTVYVDSVKGRFTISRDNAKNSVYLQMNSLRAEDTAVYYCYAYEWTNALPYWGQGTLVTVSS

SEQ ID NO: 724 - protein, 117 aa, Artificial Sequence
  Description of Artificial Sequence: Synthetic polypeptide
EVQLVESGGGLVQPGGSLTLSCAASVYSVYDLSTAWYRQAPGKKRELVAGISDDGSTVYFDSVKGRFTISRDNAKNSVYLQMNSLRAEDTAVYYCYAYSWITRSPYWGQGTLVTVSS

SEQ ID NO: 725 - protein, 117 aa, Artificial Sequence
  Description of Artificial Sequence: Synthetic polypeptide
EVQLVESGGGLVQPGGSLTLSCAASGDSVSFLSMAWYRQAPGKKRELVAGISDEGSTVYIGSVKGRFTISRDNAKNSVYLQMNSLRAEDTAVYYCYAYSWTTRRQYWGQGTLVTVSS

SEQ ID NO: 726 - protein, 117 aa, Artificial Sequence
  Description of Artificial Sequence: Synthetic polypeptide
EVQLVESGGGLVQPGGSLTLSCAASSSSVSLLSLAWYRQAPGKKRELVAGISDDGSIVYMDSVKGRFTISRDNAKNSVYLQMNSLRAEDTAVYYCYAYSWITRSPYWGQGTLVTVSS

SEQ ID NO: 727 - protein, 117 aa, Artificial Sequence
  Description of Artificial Sequence: Synthetic polypeptide
EVQLVESGGGLVQPGGSLTLSCAASADSVSFLSIAWYRQAPGKKRELVAGISDDGSKHYFDSVKGRFTISRDNAKNSVYLQMNSLRAEDTAVYYCYAYRWEESRQYWGQGTLVTVSS

SEQ ID NO: 728 - protein, 117 aa, Artificial Sequence
  Description of Artificial Sequence: Synthetic polypeptide
EVQLVESGGGLVQPGGSLTLSCAASASSVTLLSIAWYRQAPGKKRELVAGISTDGSTDYLHSVKGRFTISRDNAKNSVYLQMNSLRAEDTAVYYCYAYTWTTRLPYWGQGTLVTVTS

SEQ ID NO: 729 - protein, 117 aa, Artificial Sequence; identical to SEQ ID NO: 727
  Description of Artificial Sequence: Synthetic polypeptide

SEQ ID NO: 730 - protein, 117 aa, Artificial Sequence
  Description of Artificial Sequence: Synthetic polypeptide
EVQLVESGGGLVQPGGSLTLSCAASGTSVWLLSMAWYRQAPGKKRELVAGISYDGSTVYVESVKGRFTISRDNAKNSVYLQMNSLRAEDTAVYYCYAYSWTTRQPYWGQGTLVTVSS

SEQ ID NO: 731 - protein, 117 aa, Artificial Sequence
  Description of Artificial Sequence: Synthetic polypeptide
EVQLVESGGGLVQPGGSLTLSCAASGSSVSILSIAWYRQAPGKKRELVAGISDDGSTVYIDSVKGRFTISRDNAKNSVYLQMNSLRAEDTAVYYCYAYVWGTRLPYWGQGTLVTVSS

SEQ ID NO: 732 - protein, 117 aa, Artificial Sequence
  Description of Artificial Sequence: Synthetic polypeptide
EVQLVESGGGLVQPGGSLTLSCAASGTAVSNLSIAWYRQAPGKKRELVAGISDDGSTVYVDSVKGRFTISRDNAKNSVYLQMNSLRAEDTAVYYCYAYEWTNALPYWGQGTLVTVSS

SEQ ID NO: 733 - protein, 117 aa, Artificial Sequence
  Description of Artificial Sequence: Synthetic polypeptide
EVQLVESGGGLVQPGGSLTLSCAASGSAVSMLSLAWYRQAPGKKRELVAGISDDGSQVYIDSVKGRFTISRDNAKNSVYLQMNSLRAEDTAVYYCYAYRWEDALTYWGQGTLVTVSS

SEQ ID NO: 734 - protein, 117 aa, Artificial Sequence
  Description of Artificial Sequence: Synthetic polypeptide
EVQLVESGGGLVQPGGSLTLSCAASGMTVFFLSMAWYRQAPGKKRELVAGISVDGSTVYSDSVKGRFTISRDNAKNSVYLQMNSLRAEDTAVYYCYAYSWTTRYPYWGQGTLVTVSS

SEQ ID NO: 735 - protein, 117 aa, Artificial Sequence
  Description of Artificial Sequence: Synthetic polypeptide
EVQLVESGGGLVQPGGSLTLSCAASQYSVTFLSVAWYRQAPGKKRELVAGISDDGSNVYIDSVKGRFTISRDNAKNSVYLQMNSLRAEDTAVYYCYAYSWIDSLRYWGQGTLVTVSS

SEQ ID NO: 736 - protein, 117 aa, Artificial Sequence
  Description of Artificial Sequence: Synthetic polypeptide
EVQLVESGGGLVQPGGSLTLSCAASGETVSFLSLAWYRQAPGKKRELVAGISTDGSTVYFVSVKGRFTISRDNAKNSVYLQMNSLRAEDTAVYYCYAYSWTTPRAYWGQGTLVTVSS

SEQ ID NO: 737 - protein, 121 aa, Artificial Sequence
  Description of Artificial Sequence: Synthetic polypeptide
QVQLQESGGGLVQAGGSLRLSCAASGSIAYIYTMDWYRQAPGKQRELVATSTRDGNVDYAESVKGRFTISRDNAKNTVYLQMNSLKPEDTAVYYCNADLRTAVDLIRANYWGQGTQVTVSS

SEQ ID NO: 738 - protein, 125 aa, Artificial Sequence
  Description of Artificial Sequence: Synthetic polypeptide
QVQLQESGGGLVQAGDSLRLSCVVSGRTDSWYVMGWFRQAPGKDREFVAGVSWSYGNTYYADSVKGRFTASRDNAKNTAYLQMNSLNAEDTAVYYCAARVSREVIPTRWDLYNYWGQGTQVTVSS

SEQ ID NO: 739 - protein, 114 aa, Artificial Sequence
  Description of Artificial Sequence: Synthetic polypeptide
QVQLQESGGGSVQPGGSLRVSCVVSRTIISINAMTWYHQAPGKRRELVAIITSGGETNYADSVKGRFTISRDNAKNTAYLQMNNLKPEDTGVYYCNVVPPLGSWGQGTQVTVSS

SEQ ID NO: 740 - protein, 127 aa, Artificial Sequence
  Description of Artificial Sequence: Synthetic polypeptide
QVQLQESGGGRVQAGGSLRLSCSASARTLRLYAVGWFRQAPGKEREFVAGIGRSERTYYTDSVKGRFTLSRDNAKNTVFLEMNDLEPEDTAVYFCALTFQTTDMVDVPTTQHEYDYWGRGTQVTVSS

SEQ ID NO: 741 - protein, 121 aa, Artificial Sequence
  Description of Artificial Sequence: Synthetic polypeptide
QVQLQESGGGLVQAGGSLRLSCAASGSIAYIYTMDWYRQAPGKQRELVATSTHDGNTDYADSVKGRFTISRDNVKNTVYLQMNSLKPEDTAVYYCNADLRTAVDLIRANYWGQGTQVTVSS

SEQ ID NO: 742 - protein, 121 aa, Artificial Sequence
  Description of Artificial Sequence: Synthetic polypeptide
QVQLQESGGGLVQPGGSLRLSCAASGSIAYIYTMDWYRQAPGKQRELVATSTRDGNTDYADSVKGRFTISRDNAKDTVYLQMNSLKPEDTAVYYCNADLRTAVDLIRANYWGQGTQVTVSS

SEQ ID NO: 743 - protein, 119 aa, Artificial Sequence
  Description of Artificial Sequence: Synthetic polypeptide
QVQLQESGGGLVQAGGSLTLSCAASGRYQMAWFRQAPEKEREFVGTISSGDSTWYTNSVKGRFAISRDSARNTVYLQMNDLKPEDTAIYYCAAALYYRDSRRAADYPYWGQGTQVTVSS

SEQ ID NO: 744 - protein, 127 aa, Artificial Sequence
  Description of Artificial Sequence: Synthetic polypeptide
QVQLQESGGGRVQAGESLRLSCSTSTRTLKLYAVGWFRQAPGKERDFVAGIGRSERIYYIDSVKGRFTLSRDNAKNTVFLEMNDLEPEDTAVYFCAATFQTSDNVGVPTVQHEYDYWGQGTQVTVSS

SEQ ID NO: 745 - protein, 121 aa, Artificial Sequence
  Description of Artificial Sequence: Synthetic polypeptide
QVQLQESGGGLVQAGGSLRLSCAASGSIAYIYTMDWYRQAPGKQRELVATSTHDGNTDYADSVKGRFTISRDNAKNTVTLQMNSLKPEDTAVYYCNADLRTAVDLIRANYWGQGTQVTVSS

SEQ ID NO: 746 - protein, 121 aa, Artificial Sequence
  Description of Artificial Sequence: Synthetic polypeptide
QVQLQESGGGLVQAGGSLRLSCAASGSIAYIYTMDWYRQAPGKQRELVATFTRDGNTDYADSVKGRFTISRDNAKNTVYLQMNSLKPEDTAVYYCNTDLRTAVDLIRANYWGQGTQVTVSS

SEQ ID NO: 747 - protein, 121 aa, Artificial Sequence
  Description of Artificial Sequence: Synthetic polypeptide
QVQLQESGGGLVQAGGSLRLSCAASGSIAYIYTMDWYRQAPGKQRELVATSTHDGNTDYADSLKGRFTISRDNAKNTVYLQMNSLKPEDTAVYYCNADLRTAVDLIRANYWGQGTQVTVSS

SEQ ID NO: 748 - protein, 119 aa, Artificial Sequence
  Description of Artificial Sequence: Synthetic polypeptide
QVQLQESGGGSVQAGGSLRLSCAASGRYQMAWFRQAPEKEREFVGTISSGDSTWYTNSLKGRFAISRDSARDTVYLQMNDLKPEDTAVYYCAAALYYRDSRRAADYPYWGQGTQVTVSS

SEQ ID NO: 749 - protein, 114 aa, Artificial Sequence
  Description of Artificial Sequence: Synthetic polypeptide
QVQLQESGGGLVQTGGSLRLSCAVSGSIVTINAMTWYRQAPGKRRELVAIITSGGETNYADSVKGRFTISRDNAKNTAHLQMNSLNPEDTGVYYCNVVPPLGSWGQGTQVTVSS

SEQ ID NO: 750 - protein, 114 aa, Artificial Sequence
  Description of Artificial Sequence: Synthetic polypeptide
QVQLQESGGGLVQTGGSLRLSCAVSRSIVSIKSMTWYRQAPGKRRELVALITSGGETNYSDSVKGRFTISRDNAKNTVYLQMNSLKPEDTGVYYCNVVPPLGSWGQGTQVTVSS

SEQ ID NO: 751 - protein, 125 aa, Artificial Sequence
  Description of Artificial Sequence: Synthetic polypeptide
QVQLQESGGGLVETGGSLRLSCAGSGSTFRHHAMAWFRQTPGKEREFVSAINDHGDRTKYLDSVRGRFTISRDNTDNMVYLQMTDLRPEDTANYSCAAGPLVDYLETTPLVYTYWGHGTQVTVSS

SEQ ID NO: 752 - protein, 121 aa, Artificial Sequence
  Description of Artificial Sequence: Synthetic polypeptide
QVQLQESGGGLVQAGGSLRLSCAASGSIAYIYTMDWYRQAPGKQRELVATSTHDGNTDYADSVKGRFTISRDNAKNTVYLQMNSLKPEDTAVYYCNADLRTAVDLIRANYWGQGTQVTVSS

SEQ ID NO: 753 - protein, 121 aa, Artificial Sequence
  Description of Artificial Sequence: Synthetic polypeptide
QVQLQESGGGSVQAGGSLTLSCAASGSIAYIYTMDWYRQAPGKQRELVATSTHDGNTDYADSVKGRFTISRDNAKNTVYLQMNSLKPEDTAVYYCNADLRTAVDLIRANYWGQGTQVTVSS

SEQ ID NO: 754 - protein, 113 aa, Artificial Sequence
  Description of Artificial Sequence: Synthetic polypeptide
QVQLQESGGGLVQPGGSLRLSCTASVSIFSVNAVDWYRQSPGKERELVAIMTSDGSTNYGDSVKGRFTISRDNAKNTVYLQMNNLKPEDTAVYYCNTVPPRYWGQGTQVTVSS

SEQ ID NO: 755 - protein, 121 aa, Artificial Sequence
  Description of Artificial Sequence: Synthetic polypeptide
QVQLQESGGGLVQPGGSLRLSCAASGSIAYIYTMDWYRQAPGKQRELVATSTRDGNIDYADSVKGRFTISRDSAKNTVYLQMSSLKPEDTAVYYCNADLRTAVDLIRANYWGQGTQVTVSS

SEQ ID NO: 756 - protein, 119 aa, Artificial Sequence
  Description of Artificial Sequence: Synthetic polypeptide
QVQLQESGGGLVQAGGSLTLSCAASGRYQLAWFRQAPEKVREFVGTISSGDSTWYTNSVKGRFAISRDSARNTVYLQMNDLKPEDTAVYYCAAALYYRDSRRAADYPYWGQGTQVTVSS

SEQ ID NO: 757 - protein, 119 aa, Artificial Sequence
  Description of Artificial Sequence: Synthetic polypeptide
QVQLQESGGGSVQAGGSLRLSCAASGRYHMAWFRQAPEKEREFVGTISSGDSTWYTNSVKGRFAISRDSARNTAYLQMNDLKPEDTAVYYCAAALYYGDSRRAADYPYWGQGTQVTVSS

SEQ ID NO: 758 - protein, 121 aa, Artificial Sequence
  Description of Artificial Sequence: Synthetic polypeptide
QVQLQESGGGSVQAGGSLRLSCAASGSIAYIYTMDWYRQAPGKQRELVATSTHDGNTDYTDSVKGRFTISRDNAKNTVYLQMNSLKPEDTAVYYCNADLRTAVDLIRANYWGQGTQVTVSS

SEQ ID NO: 759 - protein, 121 aa, Artificial Sequence
  Description of Artificial Sequence: Synthetic polypeptide
QVQLQESGGGLVQAGGSLRLSCAASGSIAYIYTMDWYRQTPGKQRELVATSTRDANTDYAGSVKGRFTISRDNAKDTVYLQMNSLKPEDTAVYYCHADLRTAVDLIRANYWGQGTQVTVSS

SEQ ID NO: 760 - protein, 119 aa, Artificial Sequence
  Description of Artificial Sequence: Synthetic polypeptide
QVQLQESGGGLVQAGGSLRLSCAASGRYNMAWFRQAPEKEREFVGTITSADSTWYTNSVKGRFAITQDSARNTVYLQMNDLKPEDTAVYYCAAALYYGDSRRAADYPYWGQGTQVTVSS

SEQ ID NO: 761 - protein, 119 aa, Artificial Sequence
  Description of Artificial Sequence: Synthetic polypeptide
QVQLQESGGGLVQPGGSLRLSCAASGRYQMAWFRQAPEKEREFVGTISSGDSTWYTNSVKGRFAISRDSARTTVYLQMNDLKPEDTAVYYCAAALYYRDSWRAADYPYWGQGTQVTVSS

SEQ ID NO: 762 - protein, 119 aa, Artificial Sequence
  Description of Artificial Sequence: Synthetic polypeptide
QVQLQESGGGLVQPGESLRLSCAATGRYHLAWFRQAPEKEREFVGTITSADSTWYTNSVKGRFAITRDSARNTVYLQMNDLKPEDTAVYYCAAALYYGDSRRAADYPYWGQGTQVTVSS

SEQ ID NO: 763 - protein, 124 aa, Artificial Sequence
  Description of Artificial Sequence: Synthetic polypeptide
QVQLQESGGGLVQAGGSLKLSCADSGRSFSNYIMGWFRQAPGKEREFVAGLGWSPGNTYYADSVKGRFTISRDNAKNMVYLQMNSLNPEDTAVYYCAARRGDVIYTTPWNYVYWGQGTQVTVSS

SEQ ID NO: 764 - protein, 121 aa, Artificial Sequence
  Description of Artificial Sequence: Synthetic polypeptide
QVQLQESGGGLVQAGGSLRLSCAASGSIAYIYTMDWYRQAPGKQRELVATSTHDGNTDYADSVKGRFTISRDNAKNTVYLQMNSLKPEDTAVYYCNADLRTPVDLIRANYWGQGTQVTVSS

SEQ ID NO: 765 - protein, 119 aa, Artificial Sequence
  Description of Artificial Sequence: Synthetic polypeptide
QVQLQESGGGSVQAGGSLRLSCAAPGRYQMAWFRQAPEKEREFVGTISSGDSTWYTNSVKGRFAISRDSARNTVYLQMNDLKSEDTAVYYCAAALYYRDSRRAIDYPYWGQGTQVTVSS

SEQ ID NO: 766 - protein, 122 aa, Artificial Sequence
  Description of Artificial Sequence: Synthetic polypeptide
QVQLQESGGGSVQAGGSLRLSCAASGLTFSSYAMAWFRQAPGKQRELVARITSGGTTDYADSVKGRFTISRDNAKNTMYLQMNSLKPEDTAVYYCAADLTYRNLLLKLPHYWGQGTQVTVSS

SEQ ID NO: 767 - protein, 121 aa, Artificial Sequence
  Description of Artificial Sequence: Synthetic polypeptide
QVQLQESGGGLVQAGGSLRLSCAASGNIAYIYTMDWYRQAPGKQRELVATSTHDGSTDYADSVKGRFTISRDNAKNTVYLQMNSLKPEDTAVYYCNADLRTPVDLIRANYWGQGTQVTVSS

SEQ ID NO: 768 - protein, 121 aa, Artificial Sequence
  Description of Artificial Sequence: Synthetic polypeptide
QVQLQESGGGLVQPGGSLRLSCAASGSIAYIYTMDWYRQAPGKQRELVATSTWDGNTDYADSVKGRFTISRDNAKNTVYLQMNSLKPEDTAVYYCNADLRTAVDLIRANYWGQGTQVTVSS

SEQ ID NO: 769 - protein, 121 aa, Artificial Sequence
  Description of Artificial Sequence: Synthetic polypeptide
QVQLQESGGGLVQAGGSLRLSCAASGSIAYIYTMDWYRQAPGKQRELVATSTHDGNTDYADSVKGRFTISRDNAKNTVYLQMSSLKPDDTAVYYCNADLRTAVDLIRANYWGQGTQVTVSS

SEQ ID NO: 770 - protein, 123 aa, Artificial Sequence
  Description of Artificial Sequence: Synthetic polypeptide
QVQLQESGGGLVQAGESLSLSCAASGNDFVITDMHWYRQAPGKQREWVATITRFATTNYADSVKGRFTISRDNAKNTWYLQMNSLKPDDTAVYYCKAIGLRGVPDVNRQFEVWGQGTQVTVSS

SEQ ID NO: 771 - protein, 121 aa, Artificial Sequence
  Description of Artificial Sequence: Synthetic polypeptide
QVQLQESGGGLVQAGGSLRLSCAASGAIAYIYGMGWYRQAPGNQRELVAAISSGGSTDYADSVKGRFTISRDNAKNTVYLQMSSLKPEDTAVYYCNADVRTSRNLVRSDYWGQGTQVTVSS

SEQ ID NO: 772 - protein, 119 aa, Artificial Sequence
  Description of Artificial Sequence: Synthetic polypeptide
QVQLQESGGGLVQAGGSLRLSCAASGRYHTAWFRQAPEKEREFVGTISSGDSTWYTNSVKGRFAISRDSARNTVYLQMNDLKPEDTAVYYCAAALYYGDSRRAGDYPYWGQGTQVTVSS

SEQ ID NO: 773 - protein, 121 aa, Artificial Sequence
  Description of Artificial Sequence: Synthetic polypeptide
QVQLQESGGGLVQAGGSLRLSCAASGNIAYIYTMNWYRQAPGKQRELVATSTHAGNTDYADSVKGRFTISRDNAKNTVYLQMNSLKPEDTAVYYCNVDLRTAVDLIRANYWGQGTQVTVSS

SEQ ID NO: 774 - protein, 121 aa, Artificial Sequence
  Description of Artificial Sequence: Synthetic polypeptide
QVQLQESGGGLVQPGGSLRLSCAASGNIAYIYTMGWYRQAPGKQRELVATSTHDGNSDYADSVKGRFTISRDNAKNTVYLQMNTLKPDDTAVYYCNADLRTPVDRIRGNFWGQGTQVTVSS

SEQ ID NO: 775 - protein, 121 aa, Artificial Sequence
  Description of Artificial Sequence: Synthetic polypeptide
EVQLLESGGGLVQPGGSLTLSCAASGSIAYIYTMDWYRQAPGKQRELVATSTRDGNVDYADSVKGRFTISRDNSKNTLYLQMNSLRAEDTAVYYCNADLRTAVDLIRANYWGLGTQVTVSS

SEQ ID NO: 776 - protein, 125 aa, Artificial Sequence
  Description of Artificial Sequence: Synthetic polypeptide
EVQLLESGGGLVQPGGSLTLSCAASGRTDSWYVMGWFRQAPGKDREFVAGVSWSYGNTYYADSVKGRFTISRDNSKNTLYLQMNSLRAEDTAVYYCAARVSREVIPTRWDLYNYWGLGTQVTVSS

SEQ ID NO: 777 - protein, 127 aa, Artificial Sequence
  Description of Artificial Sequence: Synthetic polypeptide
EVQLLESGGGLVQPGGSLTLSCAASARTLRLYAVGWFRQAPGKEREFVAGIGRSERTYYTDSVKGRFTISRDNSKNTLYLQMNSLRAEDTAVYYCALTFQTTDMVDVPTTQHEYDYWGLGTQVTVSS

SEQ ID NO: 778 - protein, 114 aa, Artificial Sequence
  Description of Artificial Sequence: Synthetic polypeptide
EVQLLESGGGLVQPGGSLTLSCAASGSIVTINAMTWYRQAPGKRRELVAIITSGGETNYADSVKGRFTISRDNSKNTLYLQMNSLRAEDTAVYYCNVVPPLGSWGLGTQVTVSS

SEQ ID NO: 779 - protein, 119 aa, Artificial Sequence
  Description of Artificial Sequence: Synthetic polypeptide
EVQLLESGGGLVQPGGSLTLSCAASGRYHMAWFRQAPGKEREFVGTISSGDSTWYTNSVKGRFTISRDNSKNTLYLQMNSLRAEDTAVYYCAAALYYGDSRRAADYPYWGLGTQVTVSS

SEQ ID NO: 780 - protein, 125 aa, Artificial Sequence
  Description of Artificial Sequence: Synthetic polypeptide
EVQLLESGGGLVQPGGSLTLSCAASGSTFRHHAMAWFRQTPGKEREFVSAINDHGDRTKYLDSVKGRFTISRDNSKNTLYLQMNSLRAEDTAVYYCAAGPLVDYLETTPLVYTYWGLGTQVTVSS

SEQ ID NO: 781 - protein, 124 aa, Artificial Sequence
  Description of Artificial Sequence: Synthetic polypeptide
EVQLLESGGGLVQPGGSLTLSCAASGRSFSNYIMGWFRQAPGKEREFVAGLGWSPGNTYYADSVKGRFTISRDNSKNTLYLQMNSLRAEDTAVYYCAARRGDVIYTTPWNYVYWGLGTQVTVSS

SEQ ID NO: 782 - protein, 122 aa, Artificial Sequence
  Description of Artificial Sequence: Synthetic polypeptide
EVQLLESGGGLVQPGGSLTLSCAASGLTFSSYAMAWFRQAPGKQRELVARITSGGTTDYADSVKGRFTISRDNSKNTLYLQMNSLRAEDTAVYYCAADLTYRNLLLKLPHYWGLGTQVTVSS

SEQ ID NO: 783 - protein, 113 aa, Artificial Sequence
  Description of Artificial Sequence: Synthetic polypeptide
EVQLLESGGGLVQPGGSLTLSCAASVSIFSVNAVDWYRQSPGKERELVAIMTSDGSTNYDDSVKGRFTISRDNSKNTLYLQMNSLRAEDTAVYYCNTVPPRYWGLGTQVTVSS

SEQ ID NO: 784 - protein, 123 aa, Artificial Sequence
  Description of Artificial Sequence: Synthetic polypeptide
EVQLLESGGGLVQPGGSLTLSCAASGNDFVITDMHWYRQAPGKQREWVATITRFATTNYADSVKGRFTISRDNSKNTLYLQMNSLRAEDTAVYYCKAIGLRGVPDVNRQFEVWGLGTQVTVSS

SEQ ID NO: 785 - protein, 121 aa, Artificial Sequence
  Description of Artificial Sequence: Synthetic polypeptide
EVQLLESGGGLVQPGGSLTLSCAASGAIAYIYGMGWYRQAPGKQRELVAAISSGGSTDYADSVKGRFTISRDNSKNTLYLQMNSLRAEDTAVYYCNADVRTSRNLVRSDYWGLGTQVTVSS

SEQ ID NO: 786 - protein, 532 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGKPLGLQARVVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGRTDSWYVMGWFRQAPGKDREFVAGVSWSYGNTYYADSVKGRFTISRDNSKNTLYLQMNSLRAEDTAVYYCAARVSREVIPTRWDLYNYWGLGTQVTVSSHHHHHH

SEQ ID NO: 787 - protein, 532 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGPQASTGRSGGGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGRTDSWYVMGWFRQAPGKDREFVAGVSWSYGNTYYADSVKGRFTISRDNSKNTLYLQMNSLRAEDTAVYYCAARVSREVIPTRWDLYNYWGLGTQVTVSSHHHHHH

SEQ ID NO: 788 - protein, 532 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGPQGSTGRAAGGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGRTDSWYVMGWFRQAPGKDREFVAGVSWSYGNTYYADSVKGRFTISRDNSKNTLYLQMNSLRAEDTAVYYCAARVSREVIPTRWDLYNYWGLGTQVTVSSHHHHHH

SEQ ID NO: 789 - protein, 531 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGPPASSGRAGGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGRTDSWYVMGWFRQAPGKDREFVAGVSWSYGNTYYADSVKGRFTISRDNSKNTLYLQMNSLRAEDTAVYYCAARVSREVIPTRWDLYNYWGLGTQVTVSSHHHHHH

SEQ ID NO: 790 - protein, 531 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGPIPVQGRAHGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGRTDSWYVMGWFRQAPGKDREFVAGVSWSYGNTYYADSVKGRFTISRDNSKNTLYLQMNSLRAEDTAVYYCAARVSREVIPTRWDLYNYWGLGTQVTVSSHHHHHH

SEQ ID NO: 791 - protein, 532 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGSGGGGSGGVVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGRTDSWYVMGWFRQAPGKDREFVAGVSWSYGNTYYADSVKGRFTISRDNSKNTLYLQMNSLRAEDTAVYYCAARVSREVIPTRWDLYNYWGLGTQVTVSSHHHHHH

SEQ ID NO: 792 - protein, 503 aa, Artificial Sequence; identical to SEQ ID NO: 49
  Description of Artificial Sequence: Synthetic polypeptide

SEQ ID NO: 793 - protein, 513 aa, Artificial Sequence
  Description of Artificial Sequence: Synthetic polypeptide
EVQLLESGGGLVQPGGSLTLSCAASGRTDSWYVMGWFRQAPGKDREFVAGVSWSYGNTYYADSVKGRFTISRDNSKNTLYLQMNSLRAEDTAVYYCAARVSREVIPTRWDLYNYWGLGTQVTVSSGGGGSGGGSEVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 794 - protein, 249 aa, Artificial Sequence; identical to SEQ ID NO: 56
  Description of Artificial Sequence: Synthetic polypeptide

SEQ ID NO: 795 - protein, 5 aa, Homo sapiens
APGKG

SEQ ID NO: 796 - protein, 143 aa, Artificial Sequence; identical to SEQ ID NO: 54
  Description of Artificial Sequence: Synthetic polypeptide

SEQ ID NO: 797 - protein, 143 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGPQASTGRSGGGGGGT

SEQ ID NO: 798 - protein, 143 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGPQGSTGRAAGGGGGT

SEQ ID NO: 799 - protein, 142 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGPPASSGRAGGGGGT

SEQ ID NO: 800 - protein, 142 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGPIPVQGRAHGGGGT

SEQ ID NO: 801 - protein, 6 aa, Homo sapiens
QDGNEE

SEQ ID NO: 802 - protein, 9 aa, Homo sapiens
QDGNEEMGG

SEQ ID NO: 803 - protein, 9 aa, Homo sapiens
QDGNEEMGG

SEQ ID NO: 804 - protein, 119 aa, Artificial Sequence
  Description of Artificial Sequence: Synthetic polypeptide
QVQLQESGGGLVQAGGSLRLSCAASGFIFRAASMAWYRQSPGNERELVASISSGAFTNYADSVKARFTISRDNAKNTVYLQMNSLKPEDTAVYFCGATFLRSDGHHTINGQGTQVTVSS

SEQ ID NO: 805 - protein, 119 aa, Artificial Sequence
  Description of Artificial Sequence: Synthetic polypeptide
QVQLQESGGGLVQAGGSLRLSCAASGFIFRAASMGWFRQSPGNERELVATVSSGDFTNYADSVKGRFTISRDNAKNTVYLQMNSLKPEDTAVYFCGATFVRSDGHHTIYGQGTQVTVSS

SEQ ID NO: 806 - protein, 119 aa, Artificial Sequence
  Description of Artificial Sequence: Synthetic polypeptide
QVQLQESGGGLVQAGGSLRLSCAASGFIFRAASMDWYRQFPGNERESIATISSGGFTNYADSVKGRFTISRDNAKNTVYLQMNSLKPEDTAVYFCGATFLRSDGHHTINGQGTQVTVSS

SEQ ID NO: 807 - protein, 119 aa, Artificial Sequence
  Description of Artificial Sequence: Synthetic polypeptide
QVQLQESGGGLVQAGGSLRLSCAASGFIFRAASMGWFRQSPGNERELVATVSSGGFTNYADSVKGRFTISRDNAKNTVYLQMNSLKPEDTAVYFCGATFVRSDGHHTIYGQGTQVTVSS

SEQ ID NO: 808 - protein, 119 aa, Artificial Sequence
  Description of Artificial Sequence: Synthetic polypeptide
QVQLQESGGGLVQAGGSLRLSCAASGFIFRAASMDWYRQSPGTQPELVATISSTGFTNYANSVKGRFTISRDNAKNTVYLQMNSLKPEDTAVYFCGATFLRSDGQHSIYGQGTQVTVSS

SEQ ID NO: 809 - protein, 124 aa, Artificial Sequence
  Description of Artificial Sequence: Synthetic polypeptide
QVQLQESGGGLVHTGGSLRLSCAASGDTFLRYAMGWFRQAPGKEREFVAAITWNGGNTDYAGSLKGRFTISRDNTKNTVYLQMNSLKPEDTAVYYCAADLTFGLASSHYQYDYWGQGTQVTVSS

SEQ ID NO: 810 - protein, 124 aa, Artificial Sequence
  Description of Artificial Sequence: Synthetic polypeptide
QVQLQESGGGLVQAGGSLRLSCAASGDTFLRYAMGWFRQAPGKEREFVAAITWNGGNTDYAGSLKGRFTISRDNTKNTVYLQMNSLKPEDTAVYYCAADLTFGLASSHYQYDYWGQGTQVTVSS

SEQ ID NO: 811 - protein, 124 aa, Artificial Sequence
  Description of Artificial Sequence: Synthetic polypeptide
QVQLQESGGGLVHTGGSLRLSCAFSGDTFLRYAMGWFRQAPGKEREFVAAITWNGGNTDYADSLKGRFTISRDNTKNTVYLQMNSLRPEDTAVYYCAADLTFGLASSHYQYDYWGQGTQVTVSS

SEQ ID NO: 812 - protein, 124 aa, Artificial Sequence
  Description of Artificial Sequence: Synthetic polypeptide
QVQLQESGGGLVQPGGSLRLSCAASGDTFLRYAMGWFRQAPGKEREFVAAITWNGGNTDYAGSLKGRFTISRDNTKNTVYLQMNSLKPEDTAVYYCAADLTFGLASSHYQYDYWGQGTQVTVSS

SEQ ID NO: 813 - protein, 112 aa, Artificial Sequence
  Description of Artificial Sequence: Synthetic polypeptide
QVQLQESGGGSVLAGGSLRLSCAASGFTFSSYYMSWVRQAPGKGLEWVSGIHYTGDWTNYADSVKGRFTISRDNAKNELYLEMNNLKPEDTAVYYCARGSDKGQGTQVTVSS

SEQ ID NO: 814 - protein, 112 aa, Artificial Sequence
  Description of Artificial Sequence: Synthetic polypeptide
QVQLQESGGGSVQAGGSLRLSCAASGFTFSSYYMSWVRQAPGKGLEWVSGIHYTGDWTNYADSVKGRFTISRDNAKNELYLEMNNLKPEDTAVYYCARGSDKGQGTQVTVSS

SEQ ID NO: 815 - protein, 112 aa, Artificial Sequence
  Description of Artificial Sequence: Synthetic polypeptide
QVQLQESGGGLVQPGGSLRLSCAASGFTFSDWAMSWVRQAPGKGLEWVSGIHYGDHTTHYADFVKGRFTISRDDAKNTLYLQMNSLKPEDTAVYYCARGSTKGQGTQVTVSS

SEQ ID NO: 816 - protein, 112 aa, Artificial Sequence
  Description of Artificial Sequence: Synthetic polypeptide
QVQLQESGGGLVQPGGSLRLSCAASGFTFSDWAMSWVRQAPGKGLEWVSSIHYGDHTTHYADFVKGRFTISRDDAKNTLYLQMNSLKPEDTAVYYCEKGTTRGQGTQVTVSS

SEQ ID NO: 817 - protein, 119 aa, Artificial Sequence
  Description of Artificial Sequence: Synthetic polypeptide
QVQLQESGGGLVQAGGSLKLSCAASGNVFRAATMAWYRQAPEKQREMVATIASGGTTNYADFVKGRFTISRDNAKNTVYLQMNTLKPEDTAVYYCNAGYLTSLGPKNYWGQGTQVTVSS

SEQ ID NO: 818 - protein, 119 aa, Artificial Sequence
  Description of Artificial Sequence: Synthetic polypeptide
  MOD_RES (44)..(44): Any amino acid
QVQLQESGGGLVQPGGSLRLSCAASGNVFRAATMAWYRQAPEKXREMVATIASGGTTNYADFVKGRFTISRDNAKNTVYLQMNTLKPEDTAVYYCNAGYLTSLGPKNYWGQGTQVTVSS

SEQ ID NO: 819 - protein, 119 aa, Artificial Sequence
  Description of Artificial Sequence: Synthetic polypeptide
QVQLQESGGGLVQAGGSLRLSCAASGNVFRAATMAWYRQVPEKQREMVATIASGGTTNYADFVKGRFTISRDNAKNTVYLQMNTLKPEDTAVYYCNALYLTSLGPKSYWGQGTQVTVSS

SEQ ID NO: 820 - protein, 111 aa, Artificial Sequence
  Description of Artificial Sequence: Synthetic polypeptide
QVQLQESGGGLVQPGGSLRLSCAASGFAFGNHWMYWYRQAPGRGRELVASISSGGSTNYVDSVKGRFTISRDNARNTVYLQMYSLKPEDTAVYYCGTSDNWGQGTQVTVSS

SEQ ID NO: 821 - protein, 111 aa, Artificial Sequence
  Description of Artificial Sequence: Synthetic polypeptide
QVQLQESGGGLVQAGGSLRLSCAASGFAFGNHWMYWYRQAPGRGRELVASISSGGSTNYVDSVKGRFTISRDNARNTVYLQMYSLRPEDTAVYYCGTSDNWGQGTQVTVSS

SEQ ID NO: 822 - protein, 111 aa, Artificial Sequence
  Description of Artificial Sequence: Synthetic polypeptide
QVQLQESGGGLVQAGGSLRLSCAASGFAFGNHWMYWYRQAPGRGRELVASISSGGSTNYVDSVKGRFTISRDNARNTVYLQMYSLKPEDTAVYYCGTSDNWGQGTQVTVSS

SEQ ID NO: 823 - protein, 119 aa, Artificial Sequence
  Description of Artificial Sequence: Synthetic polypeptide
QVQLQESGGGLVQAGGSLRLSCAASGFIFRAASISWYRQSPGNERELVATINSGGFTNYADSVLGRFTISRDNAKNTGYLQMNSLKPEDTAVYFCAATFLRSDGQPPIWGQGTQVTVSS

SEQ ID NO: 824 - protein, 119 aa, Artificial Sequence
  Description of Artificial Sequence: Synthetic polypeptide
QVQLQESGGGLVQAGGSLRLSCAASGFIFRAASMGWYRQSPGNERELVATINSGGFTNYADSVKGRFTISRDNAKNTGYLQMNSLKPEDTAVYFCAATFLRSDGQPPIWGQGTQVTVSS

SEQ ID NO: 825 - protein, 122 aa, Artificial Sequence
  Description of Artificial Sequence: Synthetic polypeptide
QVQLQESGGGLVQAGGSLRLSCAASEYILSMYRMAWYRQAPGKVRELVADMSSGGTTNYADFVKGRFTISRDNDRNTVYLQMNRLQPEDTAAYYCNVAGRTGPPSYDAFNNWGQGTQVTVSS

SEQ ID NO: 826 - protein, 122 aa, Artificial Sequence
  Description of Artificial Sequence: Synthetic polypeptide
QVQLQESGGGLVQPGASLRVSCAASEYILSMYRMAWYRQAPGKVRELVADMSSGGTTNYADFVKGRFTISRDNDRNTVYLQMNRLQPEDTAAYYCNVAGRTGPPSYDAFNNWGQGTQVTVSS

SEQ ID NO: 827 - protein, 122 aa, Artificial Sequence
  Description of Artificial Sequence: Synthetic polypeptide
QVQLQESGGGLVQPGGSLRLSCAASESISSFIAVGWYRQAPGKERELVAGINRSGFTYYTDSVKGRFSISRDNAKNTVLLQMTSLKPEDTAVYYCNAGGLYFSNAYTQGDYWGQGTQVTVSS

SEQ ID NO: 828 - protein, 122 aa, Artificial Sequence
  Description of Artificial Sequence: Synthetic polypeptide
QVQLQESGGGLVQTGGSLRLSCAASESISSFIAVGWYRQAPGKERELVAGINRSGFTYYTDSVKGRFSISRDNAKNTVLLQMTSLKPEDTAVYYCNAGGLYFSNAYTQGDYWGQGTQVTVSS

SEQ ID NO: 829 - protein, 119 aa, Artificial Sequence
  Description of Artificial Sequence: Synthetic polypeptide
QVQLQESGGGLVQAGGSLRLSCAASGSVFRANVMGWYRQAPGKQHELVARIDPGGTTTYADPVKGRFTISRDNAKKTVYLQMNSLKPDDTAVYYCNAIILLSGGPKDYWGQGTQVTVSS

SEQ ID NO: 830 - protein, 120 aa, Artificial Sequence
  Description of Artificial Sequence: Synthetic polypeptide
QVQLQESGGGLVQAGGSLRLSCAPSGRTSSIFGMGWFRQAPGKEREFVASINWSGGSTSYADSVKGRFTISRDNAKNEMYLQMNSLKFEDTAVYVCAAAVLTNKPSWNFWGQGTQVTVSS

SEQ ID NO: 831 - protein, 121 aa, Artificial Sequence
  Description of Artificial Sequence: Synthetic polypeptide
QVQLQESGGGLVQAGGSLRLSCAASGPIFSDTIRTMGWYRQAAGKQRELVATIASFPSRTNYVDSVKGRFTISRDIAKNTVYLQMDSLKPEDTAVYYCNVDLASIPTKTYWGQGTQVTVSS

SEQ ID NO: 832 - protein, 120 aa, Artificial Sequence
  Description of Artificial Sequence: Synthetic polypeptide
QVQLQESGGGLVQAGGSLRLSCAASGSIFGINAMGWYRQAPGKQRESVAFITIGGNTNYLDSVKGRFTISRDNAKNTVYLQMNGLKPEDTAVYYCNTNPPLILTAGGLYWGQGTQVTVSS

SEQ ID NO: 833 - protein, 121 aa, Artificial Sequence
  Description of Artificial Sequence: Synthetic polypeptide
QVQLQESGGGLVQPGGSLRLSCATSANRFNINVMGWYRQAPGQQRELVATINIGGSTDYADSVKGRFTISRDNAKNTVYLQLSDLKPEDTAVYYCNVKLRVSGPTGPNVYWGQGTQVTVSS

SEQ ID NO: 834 - protein, 116 aa, Artificial Sequence
  Description of Artificial Sequence: Synthetic polypeptide
QVQLQESGGGLVQAGGSLKLSCTASGTILSTMAWYRQAPGKQRELVATISRGGTTNYSDSVKGRFAISRDSTKNTVYLQMNSLKPEDTAVYYCNTPLTDYGMGYNWGQGTQVTVSS

SEQ ID NO: 835 - protein, 120 aa, Artificial Sequence
  Description of Artificial Sequence: Synthetic polypeptide
QVQLQESGGGLVQAGGSLRLSCAVSGSIFSLNTLAWYRQAPGRQRDLIARITGGGTTVYADSVKGRFTISRDNAKNTVYLQMNSLKPEDTAVYYCNLMVRHPSGSTYEYWGQGTQVTVSS

SEQ ID NO: 836 - protein, 119 aa, Artificial Sequence
  Description of Artificial Sequence: Synthetic polypeptide
QVQLQESGGGLVQAGGSLRLSCAASGIIFRGTTMGWFRQAPGKQRESVASISPLGTTSYSGSVEGRFTVSRDNAKNTLFLQMNSLKSEDTAVYYCNAIQVTNVGPRVYWGQGTQVTVSS

SEQ ID NO: 837 - protein, 124 aa, Artificial Sequence
  Description of Artificial Sequence: Synthetic polypeptide
QVQLQESGGGLVQPGGSLRLSCASSGFTLDDYTIGWFRQAPGKEREGVSCISRRDDSTYYADSVKGRFTISRDNAKNTVDLQMISLRPEDTAVYYCAATPRSYTLRCLGKFDFQGQGTQVTVSS

SEQ ID NO: 838 - protein, 121 aa, Artificial Sequence
  Description of Artificial Sequence: Synthetic polypeptide
QVQLQESGGGLVQAGGSLRLSCAASGNIVRMTNMAWYRQAPGKQREFVATISAGGSTTYVDSVKDRFTISRDNTKNTVYLQMNYLKPEDTAVYYCATGSILTNRGAIPGSWGHGTQVTVSS

SEQ ID NO: 839 - protein, 127 aa, Artificial Sequence
  Description of Artificial Sequence: Synthetic polypeptide
QVQLQESGGGLVQAGGSLRLSCAAPGFAFNDHAILWFRQAPGKEREGVSEICRDGTTYYTDSVKGRFTISSDNAKNTVYLQMNSVKTDDTAVYYCAVDRRRYYCSGNRAFSSDYYYWGQGTQVTVSS

SEQ ID NO: 840 - protein, 119 aa, Artificial Sequence
  Description of Artificial Sequence: Synthetic polypeptide
QVQLQESGGGLVQAGGSLRLSCVHSGSIFRASTMAWYRQAPGKQRELVAQIMSGGGTNYAGSVKGRFTISRDNANNTVYLQMNSLKPEDTAVYYCNAAQITSWGPKVYWGQGTQVTVSS

SEQ ID NO: 841 - protein, 122 aa, Artificial Sequence
  Description of Artificial Sequence: Synthetic polypeptide
QVQLQESGGGLVQPGGSLRLSCAASGRINSINTMGWYRQAPGNQRELVAEITRGGTTNYADSVQGRYAISRDNAKNLVYLQMNSLKPEDTDVYYCNAQTFPTFSRPTGLDYWGQGTQVTVSS

SEQ ID NO: 842 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGSVFRANVMGWYRQAPGKQHELVARIDPGGTTTYADPVKGRFTISRDNAKKTVYLQMNSLKPDDTAVYYCNAIILLSGGPKDYWGQGTQVTVSSHHHHHH

SEQ ID NO: 843 - protein, 395 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQPGGSLRLSCASSGFTLDDYTIGWFRQAPGKEREGVSCISRRDDSTYYADSVKGRFTISRDNAKNTVDLQMISLRPEDTAVYYCAATPRSYTLRCLGKFDFQGQGTQVTVSSHHHHHH

SEQ ID NO: 844 - protein, 392 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGNIVRMTNMAWYRQAPGKQREFVATISAGGSTTYVDSVKDRFTISRDNTKNTVYLQMNYLKPEDTAVYYCATGSILTNRGAIPGSWGHGTQVTVSSHHHHHH

SEQ ID NO: 845 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGFIFRAASISWYRQSPGNERELVATINSGGFTNYADSVLGRFTISRDNAKNTGYLQMNSLKPEDTAVYFCAATFLRSDGQPPIWGQGTQVTVSSHHHHHH

SEQ ID NO: 846 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGNVFRAATMAWYRQVPEKQREMVATIASGGTTNYADFVKGRFTISRDNAKNTVYLQMNTLKPEDTAVYYCNALYLTSLGPKSYWGQGTQVTVSSHHHHHH

SEQ ID NO: 847 - protein, 398 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAAPGFAFNDHAILWFRQAPGKEREGVSEICRDGTTYYTDSVKGRFTISSDNAKNTVYLQMNSVKTDDTAVYYCAVDRRRYYCSGNRAFSSDYYYWGQGTQVTVSSHHHHHH

SEQ ID NO: 848 - protein, 382 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQPGGSLRLSCAASGFAFGNHWMYWYRQAPGRGRELVASISSGGSTNYVDSVKGRFTISRDNARNTVYLQMYSLKPEDTAVYYCGTSDNWGQGTQVTVSSHHHHHH

SEQ ID NO: 849 - protein, 395 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQPGGSLRLSCAASGDTFLRYAMGWFRQAPGKEREFVAAITWNGGNTDYAGSLKGRFTISRDNTKNTVYLQMNSLKPEDTAVYYCAADLTFGLASSHYQYDYWGQGTQVTVSSHHHHHH

SEQ ID NO: 850 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGFIFRAASMDWYRQFPGNERESIATISSGGFTNYADSVKGRFTISRDNAKNTVYLQMNSLKPEDTAVYFCGATFLRSDGHHTINGQGTQVTVSSHHHHHH

SEQ ID NO: 851 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGFIFRAASMGWFRQSPGNERELVATVSSGGFTNYADSVKGRFTISRDNAKNTVYLQMNSLKPEDTAVYFCGATFVRSDGHHTIYGQGTQVTVSSHHHHHH

SEQ ID NO: 852 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCVHSGSIFRASTMAWYRQAPGKQRELVAQIMSGGGTNYAGSVKGRFTISRDNANNTVYLQMNSLKPEDTAVYYCNAAQITSWGPKVYWGQGTQVTVSSHHHHHH

SEQ ID NO: 853 - protein, 383 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQPGGSLRLSCAASGFTFSDWAMSWVRQAPGKGLEWVSSIHYGDHTTHYADFVKGRFTISRDDAKNTLYLQMNSLKPEDTAVYYCEKGTTRGQGTQVTVSSHHHHHH

SEQ ID NO: 854 - protein, 393 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQPGASLRVSCAASEYILSMYRMAWYRQAPGKVRELVADMSSGGTTNYADFVKGRFTISRDNDRNTVYLQMNRLQPEDTAAYYCNVAGRTGPPSYDAFNNWGQGTQVTVSSHHHHHH

SEQ ID NO: 855 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGFIFRAASMDWYRQSPGTQPELVATISSTGFTNYANSVKGRFTISRDNAKNTVYLQMNSLKPEDTAVYFCGATFLRSDGQHSIYGQGTQVTVSSHHHHHH

SEQ ID NO: 856 - protein, 393 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQPGGSLRLSCAASGRINSINTMGWYRQAPGNQRELVAEITRGGTTNYADSVQGRYAISRDNAKNLVYLQMNSLKPEDTDVYYCNAQTFPTFSRPTGLDYWGQGTQVTVSSHHHHHH

SEQ ID NO: 857 - protein, 393 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQPGGSLRLSCAASESISSFIAVGWYRQAPGKERELVAGINRSGFTYYTDSVKGRFSISRDNAKNTVLLQMTSLKPEDTAVYYCNAGGLYFSNAYTQGDYWGQGTQVTVSSHHHHHH

SEQ ID NO: 858 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLKLSCAASGNVFRAATMAWYRQAPEKQREMVATIASGGTTNYADFVKGRFTISRDNAKNTVYLQMNTLKPEDTAVYYCNAGYLTSLGPKNYWGQGTQVTVSSHHHHHH

SEQ ID NO: 859 - protein, 383 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGSVQAGGSLRLSCAASGFTFSSYYMSWVRQAPGKGLEWVSGIHYTGDWTNYADSVKGRFTISRDNAKNELYLEMNNLKPEDTAVYYCARGSDKGQGTQVTVSSHHHHHH

SEQ ID NO: 860 - protein, 391 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAPSGRTSSIFGMGWFRQAPGKEREFVASINWSGGSTSYADSVKGRFTISRDNAKNEMYLQMNSLKFEDTAVYVCAAAVLTNKPSWNFWGQGTQVTVSSHHHHHH

SEQ ID NO: 861 - protein, 392 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGPIFSDTIRTMGWYRQAAGKQRELVATIASFPSRTNYVDSVKGRFTISRDIAKNTVYLQMDSLKPEDTAVYYCNVDLASIPTKTYWGQGTQVTVSSHHHHHH

SEQ ID NO: 862 - protein, 391 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGSIFGINAMGWYRQAPGKQRESVAFITIGGNTNYLDSVKGRFTISRDNAKNTVYLQMNGLKPEDTAVYYCNTNPPLILTAGGLYWGQGTQVTVSSHHHHHH

SEQ ID NO: 863 - protein, 392 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQPGGSLRLSCATSANRFNINVMGWYRQAPGQQRELVATINIGGSTDYADSVKGRFTISRDNAKNTVYLQLSDLKPEDTAVYYCNVKLRVSGPTGPNVYWGQGTQVTVSSHHHHHH

SEQ ID NO: 864 - protein, 387 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLKLSCTASGTILSTMAWYRQAPGKQRELVATISRGGTTNYSDSVKGRFAISRDSTKNTVYLQMNSLKPEDTAVYYCNTPLTDYGMGYNWGQGTQVTVSSHHHHHH

SEQ ID NO: 865 - protein, 391 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAVSGSIFSLNTLAWYRQAPGRQRDLIARITGGGTTVYADSVKGRFTISRDNAKNTVYLQMNSLKPEDTAVYYCNLMVRHPSGSTYEYWGQGTQVTVSSHHHHHH

SEQ ID NO: 866 - protein, 383 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQPGGSLRLSCAASGFTFSDWAMSWVRQAPGKGLEWVSGIHYGDHTTHYADFVKGRFTISRDDAKNTLYLQMNSLKPEDTAVYYCARGSTKGQGTQVTVSSHHHHHH

SEQ ID NO: 867 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGFIFRAASMAWYRQSPGNERELVASISSGAFTNYADSVKARFTISRDNAKNTVYLQMNSLKPEDTAVYFCGATFLRSDGHHTINGQGTQVTVSSHHHHHH

SEQ ID NO: 868 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSQVQLQESGGGLVQAGGSLRLSCAASGIIFRGTTMGWFRQAPGKQRESVASISPLGTTSYSGSVEGRFTVSRDNAKNTLFLQMNSLKSEDTAVYYCNAIQVTNVGPRVYWGQGTQVTVSSHHHHHH

SEQ ID NO: 869 - protein, 387 aa, Artificial Sequence
  Description of Artificial Sequence: Synthetic polypeptide
GGGSQVQLQESGGGLVQAGGSLRLSCAASGSVFRANVMGWYRQAPGKQHELVARIDPGGTTTYADPVKGRFTISRDNAKKTVYLQMNSLKPDDTAVYYCNAIILLSGGPKDYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 870 - protein, 392 aa, Artificial Sequence
  Description of Artificial Sequence: Synthetic polypeptide
GGGSQVQLQESGGGLVQPGGSLRLSCASSGFTLDDYTIGWFRQAPGKEREGVSCISRRDDSTYYADSVKGRFTISRDNAKNTVDLQMISLRPEDTAVYYCAATPRSYTLRCLGKFDFQGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 871 - protein, 389 aa, Artificial Sequence
  Description of Artificial Sequence: Synthetic polypeptide
GGGSQVQLQESGGGLVQAGGSLRLSCAASGNIVRMTNMAWYRQAPGKQREFVATISAGGSTTYVDSVKDRFTISRDNTKNTVYLQMNYLKPEDTAVYYCATGSILTNRGAIPGSWGHGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 872 - protein, 387 aa, Artificial Sequence
  Description of Artificial Sequence: Synthetic polypeptide
GGGSQVQLQESGGGLVQAGGSLRLSCAASGFIFRAASISWYRQSPGNERELVATINSGGFTNYADSVLGRFTISRDNAKNTGYLQMNSLKPEDTAVYFCAATFLRSDGQPPIWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 873 - protein, 387 aa, Artificial Sequence
  Description of Artificial Sequence: Synthetic polypeptide
GGGSQVQLQESGGGLVQAGGSLRLSCAASGNVFRAATMAWYRQVPEKQREMVATIASGGTTNYADFVKGRFTISRDNAKNTVYLQMNTLKPEDTAVYYCNALYLTSLGPKSYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 874 - protein, 395 aa, Artificial Sequence
  Description of Artificial Sequence: Synthetic polypeptide
GGGSQVQLQESGGGLVQAGGSLRLSCAAPGFAFNDHAILWFRQAPGKEREGVSEICRDGTTYYTDSVKGRFTISSDNAKNTVYLQMNSVKTDDTAVYYCAVDRRRYYCSGNRAFSSDYYYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 875 - protein, 379 aa, Artificial Sequence
  Description of Artificial Sequence: Synthetic polypeptide
GGGSQVQLQESGGGLVQPGGSLRLSCAASGFAFGNHWMYWYRQAPGRGRELVASISSGGSTNYVDSVKGRFTISRDNARNTVYLQMYSLKPEDTAVYYCGTSDNWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 876 - protein, 392 aa, Artificial Sequence
  Description of Artificial Sequence: Synthetic polypeptide
GGGSQVQLQESGGGLVQPGGSLRLSCAASGDTFLRYAMGWFRQAPGKEREFVAAITWNGGNTDYAGSLKGRFTISRDNTKNTVYLQMNSLKPEDTAVYYCAADLTFGLASSHYQYDYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 877 - protein, 387 aa, Artificial Sequence
  Description of Artificial Sequence: Synthetic polypeptide
GGGSQVQLQESGGGLVQAGGSLRLSCAASGFIFRAASMDWYRQFPGNERESIATISSGGFTNYADSVKGRFTISRDNAKNTVYLQMNSLKPEDTAVYFCGATFLRSDGHHTINGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 878 - protein, 387 aa, Artificial Sequence
  Description of Artificial Sequence: Synthetic polypeptide
GGGSQVQLQESGGGLVQAGGSLRLSCAASGFIFRAASMGWFRQSPGNERELVATVSSGGFTNYADSVKGRFTISRDNAKNTVYLQMNSLKPEDTAVYFCGATFVRSDGHHTIYGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 879 - protein, 387 aa, Artificial Sequence
  Description of Artificial Sequence: Synthetic polypeptide
GGGSQVQLQESGGGLVQAGGSLRLSCVHSGSIFRASTMAWYRQAPGKQRELVAQIMSGGGTNYAGSVKGRFTISRDNANNTVYLQMNSLKPEDTAVYYCNAAQITSWGPKVYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 880 - protein, 380 aa, Artificial Sequence
  Description of Artificial Sequence: Synthetic polypeptide
GGGSQVQLQESGGGLVQPGGSLRLSCAASGFTFSDWAMSWVRQAPGKGLEWVSSIHYGDHTTHYADFVKGRFTISRDDAKNTLYLQMNSLKPEDTAVYYCEKGTTRGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 881 - protein, 390 aa, Artificial Sequence
  Description of Artificial Sequence: Synthetic polypeptide
GGGSQVQLQESGGGLVQPGASLRVSCAASEYILSMYRMAWYRQAPGKVRELVADMSSGGTTNYADFVKGRFTISRDNDRNTVYLQMNRLQPEDTAAYYCNVAGRTGPPSYDAFNNWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 882 - protein, 387 aa, Artificial Sequence
  Description of Artificial Sequence: Synthetic polypeptide
GGGSQVQLQESGGGLVQAGGSLRLSCAASGFIFRAASMDWYRQSPGTQPELVATISSTGFTNYANSVKGRFTISRDNAKNTVYLQMNSLKPEDTAVYFCGATFLRSDGQHSIYGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 883 - protein, 390 aa, Artificial Sequence
  Description of Artificial Sequence: Synthetic polypeptide
GGGSQVQLQESGGGLVQPGGSLRLSCAASGRINSINTMGWYRQAPGNQRELVAEITRGGTTNYADSVQGRYAISRDNAKNLVYLQMNSLKPEDTDVYYCNAQTFPTFSRPTGLDYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 884 - protein, 390 aa, Artificial Sequence
  Description of Artificial Sequence: Synthetic polypeptide
GGGSQVQLQESGGGLVQPGGSLRLSCAASESISSFIAVGWYRQAPGKERELVAGINRSGFTYYTDSVKGRFSISRDNAKNTVLLQMTSLKPEDTAVYYCNAGGLYFSNAYTQGDYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 885 - protein, 387 aa, Artificial Sequence
  Description of Artificial Sequence: Synthetic polypeptide
GGGSQVQLQESGGGLVQAGGSLKLSCAASGNVFRAATMAWYRQAPEKQREMVATIASGGTTNYADFVKGRFTISRDNAKNTVYLQMNTLKPEDTAVYYCNAGYLTSLGPKNYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 886 - protein, 380 aa, Artificial Sequence
  Description of Artificial Sequence: Synthetic polypeptide
GGGSQVQLQESGGGSVQAGGSLRLSCAASGFTFSSYYMSWVRQAPGKGLEWVSGIHYTGDWTNYADSVKGRFTISRDNAKNELYLEMNNLKPEDTAVYYCARGSDKGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 887 - protein, 388 aa, Artificial Sequence
  Description of Artificial Sequence: Synthetic polypeptide
GGGSQVQLQESGGGLVQAGGSLRLSCAPSGRTSSIFGMGWFRQAPGKEREFVASINWSGGSTSYADSVKGRFTISRDNAKNEMYLQMNSLKFEDTAVYVCAAAVLTNKPSWNFWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 888 - protein, 389 aa, Artificial Sequence
  Description of Artificial Sequence: Synthetic polypeptide
GGGSQVQLQESGGGLVQAGGSLRLSCAASGPIFSDTIRTMGWYRQAAGKQRELVATIASFPSRTNYVDSVKGRFTISRDIAKNTVYLQMDSLKPEDTAVYYCNVDLASIPTKTYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 889 - protein, 388 aa, Artificial Sequence
  Description of Artificial Sequence: Synthetic polypeptide
GGGSQVQLQESGGGLVQAGGSLRLSCAASGSIFGINAMGWYRQAPGKQRESVAFITIGGNTNYLDSVKGRFTISRDNAKNTVYLQMNGLKPEDTAVYYCNTNPPLILTAGGLYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 890 - protein, 389 aa, Artificial Sequence
  Description of Artificial Sequence: Synthetic polypeptide
GGGSQVQLQESGGGLVQPGGSLRLSCATSANRFNINVMGWYRQAPGQQRELVATINIGGSTDYADSVKGRFTISRDNAKNTVYLQLSDLKPEDTAVYYCNVKLRVSGPTGPNVYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 891 - protein, 384 aa, Artificial Sequence
  Description of Artificial Sequence: Synthetic polypeptide
GGGSQVQLQESGGGLVQAGGSLKLSCTASGTILSTMAWYRQAPGKQRELVATISRGGTTNYSDSVKGRFAISRDSTKNTVYLQMNSLKPEDTAVYYCNTPLTDYGMGYNWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 892 - protein, 388 aa, Artificial Sequence
  Description of Artificial Sequence: Synthetic polypeptide
GGGSQVQLQESGGGLVQAGGSLRLSCAVSGSIFSLNTLAWYRQAPGRQRDLIARITGGGTTVYADSVKGRFTISRDNAKNTVYLQMNSLKPEDTAVYYCNLMVRHPSGSTYEYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 893 - protein, 380 aa, Artificial Sequence
  Description of Artificial Sequence: Synthetic polypeptide
GGGSQVQLQESGGGLVQPGGSLRLSCAASGFTFSDWAMSWVRQAPGKGLEWVSGIHYGDHTTHYADFVKGRFTISRDDAKNTLYLQMNSLKPEDTAVYYCARGSTKGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 894 - protein, 387 aa, Artificial Sequence
  Description of Artificial Sequence: Synthetic polypeptide
GGGSQVQLQESGGGLVQAGGSLRLSCAASGFIFRAASMAWYRQSPGNERELVASISSGAFTNYADSVKARFTISRDNAKNTVYLQMNSLKPEDTAVYFCGATFLRSDGHHTINGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 895 - protein, 387 aa, Artificial Sequence
  Description of Artificial Sequence: Synthetic polypeptide
GGGSQVQLQESGGGLVQAGGSLRLSCAASGIIFRGTTMGWFRQAPGKQRESVASISPLGTTSYSGSVEGRFTVSRDNAKNTLFLQMNSLKSEDTAVYYCNAIQVTNVGPRVYWGQGTQVTVSSGGGGSGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGGSGGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLHHHHHH

SEQ ID NO: 896 - protein, 111 aa, Artificial Sequence
  Description of Artificial Sequence: Synthetic polypeptide
EVQLVESGGGLVQPGGSLTLSCAASGFAFGNHWMYWYRQAPGRGRELVASISSGGSTNYVDSVKGRFTISRDNAKNTLYLQMNSLRAEDTAVYYCGTSDNWGQGTLVTVSS

SEQ ID NO: 897 - protein, 119 aa, Artificial Sequence
  Description of Artificial Sequence: Synthetic polypeptide
EVQLLESGGGLVQPGGSLTLSCAASGFIFRAASMDWYRQFPGNERESIATISSGGFTNYADSVKGRFTISRDNSKNTLYLQMNSLRAEDTAVYYCGATFLRSDGHHTINGQGTLVTVSS

SEQ ID NO: 898 - protein, 119 aa, Artificial Sequence
  Description of Artificial Sequence: Synthetic polypeptide
EVQLLESGGGLVQPGGSLTLSCAASGFIFRAASMAWYRQSPGNERELVASISSGAFTNYADSVKARFTISRDNSKNTLYLQMNSLRAEDTAVYYCGATFLRSDGHHTINGQGTLVTVSS

SEQ ID NO: 899 - protein, 382 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLVESGGGLVQPGGSLTLSCAASGFAFGNHWMYWYRQAPGRGRELVASISSGGSTNYVDSVKGRFTISRDNAKNTLYLQMNSLRAEDTAVYYCGTSDNWGQGTLVTVSSHHHHHH

SEQ ID NO: 900 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGFIFRAASMDWYRQFPGNERESIATISSGGFTNYADSVKGRFTISRDNSKNTLYLQMNSLRAEDTAVYYCGATFLRSDGHHTINGQGTLVTVSSHHHHHH

SEQ ID NO: 901 - protein, 390 aa, Artificial Sequence
  Description of Artificial Sequence: Synthetic polypeptide
VVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGFIFRAASMAWYRQSPGNERELVASISSGAFTNYADSVKARFTISRDNSKNTLYLQMNSLRAEDTAVYYCGATFLRSDGHHTINGQGTLVTVSSHHHHHH

SEQ ID NO: 902 - protein, 12 aa, Artificial Sequence
  Description of Artificial Sequence: Synthetic peptide
QDGNEEMGGITQ

SEQ ID NO: 903 - protein, 6 aa, Homo sapiens
LVQPGN

SEQ ID NO: 904 - protein, 6 aa, Homo sapiens
DSVKGR

SEQ ID NO: 905 - protein, 6 aa, Homo sapiens
SLRPED

SEQ ID NO: 906 - protein, 507 aa, Artificial Sequence
  Description of Artificial Sequence: Synthetic polypeptide
EVQLVESGGGLVQPGNSLRLSCAASGFTFSKFGMSWVRQAPGKGLEWVSSISGSGRDTLYADSVKGRFTISRDNAKTTLYLQMNSLRPEDTAVYYCTIGGSLSVSSQGTLVTVSSGGGGSGGGSQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGFIFRAASMAWYRQSPGNERELVASISSGAFTNYADSVKARFTISRDNSKNTLYLQMNSLRAEDTAVYYCGATFLRSDGHHTINGQGTLVTVSSHHHHHH

SEQ ID NO: 907 - protein, 383 aa, Artificial Sequence
  Description of Artificial Sequence: Synthetic polypeptide
QTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGFIFRAASMAWYRQSPGNERELVASISSGAFTNYADSVKARFTISRDNSKNTLYLQMNSLRAEDTAVYYCGATFLRSDGHHTINGQGTLVTVSSHHHHHH

SEQ ID NO: 908 - protein, 526 aa, Artificial Sequence
  Description of Artificial Sequence: Synthetic polypeptide
EVQLVESGGGLVQPGNSLRLSCAASGFTFSKFGMSWVRQGGGGGLDGNEEPGGLEWVSSISGSGRDTLYADSVKGRFTISRDNAKTTLYLQMNSLRPEDTAVYYCTIGGSLSVSSQGTLVTVSSGGGGSGGGGSGGVVGGGGTQTVVTQEPSLTVSPGGTVTLTCASSTGAVTSGNYPNWVQQKPGQAPRGLIGGTKFLVPGTPARFSGSLLGGKAALTLSGVQPEDEAEYYCTLWYSNRWVFGGGTKLTVLGGGGSGGGGSGGGGSEVQLVESGGGLVQPGGSLKLSCAASGFTFNKYAINWVRQAPGKGLEWVARIRSKYNNYATYYADQVKDRFTISRDDSKNTAYLQMNNLKTEDTAVYYCVRHANFGNSYISYWAYWGQGTLVTVSSGGGGSGGGSEVQLLESGGGLVQPGGSLTLSCAASGFIFRAASMAWYRQSPGNERELVASISSGAFTNYADSVKARFTISRDNSKNTLYLQMNSLRAEDTAVYYCGATFLRSDGHHTINGQGTLVTVSSHHHHHH

SEQ ID NO: 909 - protein, 10 aa, Unknown
  Description of Unknown: Protease cleavage site sequence
PQGSTARSAG

SEQ ID NO: 910 - protein, 114 aa, Artificial Sequence
  Description of Artificial Sequence: Synthetic polypeptide
QVQLQESGGGLVQAGGSLRLSCAASGSVSMFNSMGWHRQPPGKQRELVAIITSGGSSNYADTVKGRFTISRDNTKNTVYLQMNDLKPEDTAVYYCFYYFQSSYWGQGTQVTVSS

SEQ ID NO: 911 - protein, 119 aa, Artificial Sequence
  Description of Artificial Sequence: Synthetic polypeptide
EVQLVESGGGLVQPGGSLTLSCVASGKTSSINAMGWYRRAPGKQRELVAGISSDGSKVYADSVKGRFTISRDNAKNSVYLQMNSLRAEDTAVYYCYYFRTVSGVSMRYWGQGTLVTVSS

SEQ ID NO: 912 - protein, 119 aa, Artificial Sequence
  Description of Artificial Sequence: Synthetic polypeptide
EVQLVESGGGLVQPGGSLTLSCVASGSTSSINAVGWYRRAPGKQRELVAGISSDGSKVYRDSVKGRFTISRDNAKNSVYLQMNSLRAEDTAVYYCYYFRTVQGSSMRYWGQGTLVTVSS

SEQ ID NO: 913 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGVSSDGSKVYADSVKGRFTISRDNAKNSVYLQMNSLRAEDTAVYYCYYFRTVSGSSARYWGQGTLVTVSS

SEQ ID NO: 914 - protein, 119 aa, Artificial Sequence
  Description of Artificial Sequence: Synthetic polypeptide
EVQLVESGGGLVQPGGSLTLSCVASGSTSSINAMGWYRRAPGKQRELPAGISRDGSKVYADSVKGRFTISRDNAKNSVYLQMNSLRAEDTAVYYCYYFRYVSGSSMRYWGQGTLVTVSS

SEQ ID NO: 915 - protein, 119 aa, Artificial Sequence
  Description of Artificial Sequence: Synthetic polypeptide
EVQLVESGGGLVQPGGSLTLSCVASGSTSSINAMGWYRRAPGKQRELAAGISSDGSKLYADSVKGRFTISRDNAKNSVYLQMNSLRAEDTAVYYCYYFRTVSGSSMRYWGQGTLVTVSS

SEQ ID NO: 916 - protein, 119 aa, Artificial Sequence
  Description of Artificial Sequence: Synthetic polypeptide
EVQLVESGGGLVQPGGSLTLSCVASGSTSRINAMGWYRRAPGKQRELVAGISSDGSKVYADSVKGRFTISRDNAKNSVYLQMNSLRAEDTAVYYCYYFRRVSGSSMRYWGQGTLVTVSS

SEQ ID NO: 917 - protein, 119 aa, Artificial Sequence
  Description of Artificial Sequence: Synthetic polypeptide
EVQLVESGGGLVQPGGSLTLSCVASGSTSSINAMAWYRRAPGKQRELAAGISSDGSKVYADSVKGRFTISRDNAKNSVYLQMNSLRAEDTAVYYCYYFHTVSGSSMRYWGQGTLVTVSS

SEQ ID NO: 918 - protein, 119 aa, Artificial Sequence
  Description of Artificial Sequence: Synthetic polypeptide
EVQLVESGGGLVQPGGSLTLSCVASGSTSSINAMAWYRRAPGKQRELVAGISSDGSKVYADSVKGRFTISRDNAKNSVYLQMNSLRAEDTAVYYCYYFRQVSGSSMRYWGQGTLVTVSS

SEQ ID NO: 919 - protein, 119 aa, Artificial Sequence
  Description of Artificial Sequence: Synthetic polypeptide
EVQLVESGGGLVQPGGSLTLSCVASGSTSSINAMGWYRRAPGKQRELVAGISSDTSKVYADSVKGRFTISRDNAKNSVYLQMNSLRAEDTAVYYCYYFRTVSGSYMRYWGQGTLVTVSS

SEQ ID NO: 920 - protein, 119 aa, Artificial Sequence
  Description of Artificial Sequence: Synthetic polypeptide
EVQLVESGGGLVQPGGSLTLSCVASGSTSTINAMGWYRRAPGKQRELVAGISSDGSKVYADSVKGRFTISRDNAKNSVYLQMNSLRAEDTAVYYCYYFRTASGSSMRYWGQGTLVTVSS

SEQ ID NO: 921 - protein, 5 aa, Homo sapiens
QDGNE

SEQ ID NO: 922 - protein, 4 aa, Homo sapiens
DGNE

SEQ ID NO: 923 - protein, 5 aa, Homo sapiens
DGNEE

SEQ ID NO: 924 - protein, 8 aa, Unknown
  Description of Unknown: protease cleavage site
GPLGIAGQ

SEQ ID NO: 925 - protein, 8 aa, Unknown
  Description of Unknown: protease cleavage site
AVRWLLTA

SEQ ID NO: 926 - protein, 6 aa, Unknown
  Description of Unknown: protease cleavage site
RRRRRR

SEQ ID NO: 927 - protein, 6 aa, Artificial Sequence
  Description of Artificial Sequence: Synthetic 6xHis tag
HHHHHH

SEQ ID NO: 928 - protein, 9 aa, Artificial Sequence
  Description of Artificial Sequence: Synthetic peptide
GGGGSGGGS

SEQ ID NO: 929 - protein, 18 aa, Artificial Sequence
  Description of Artificial Sequence: Synthetic peptide
  MOD_RES (5)..(14): Any amino acid
GGGGXXXXXXXXXXGGGG

SEQ ID NO: 930 - protein, 6 aa, Artificial Sequence
  Description of Artificial Sequence: Synthetic peptide
LVQPGN

SEQ ID NO: 931 - protein, 5 aa, Artificial Sequence
  Description of Artificial Sequence: Synthetic peptide
APGKG

SEQ ID NO: 932 - protein, 6 aa, Artificial Sequence
  Description of Artificial Sequence: Synthetic peptide
DSVKGR

SEQ ID NO: 933 - protein, 6 aa, Artificial Sequence
  Description of Artificial Sequence: Synthetic peptide
SLRPED

SEQ ID NO: 934 - protein, 8 aa, Artificial Sequence
  Description of Artificial Sequence: Synthetic peptide
  MOD_RES (4)..(4): Any amino acid
CFCXLCFR

SEQ ID NO: 935 - protein, 5 aa, Artificial Sequence
  Description of Artificial Sequence: Synthetic peptide
STQDM

SEQ ID NO: 936 - protein, 6 aa, Artificial Sequence
  Description of Artificial Sequence: Synthetic peptide
DSVKGR

SEQ ID NO: 937 - protein, 6 aa, Artificial Sequence
  Description of Artificial Sequence: Synthetic peptide
SLRPED

SEQ ID NO: 938 - protein, 6 aa, Artificial Sequence
  Description of Artificial Sequence: Synthetic peptide
LVQPGN

SEQ ID NO: 939 - protein, 5 aa, Artificial Sequence
  Description of Artificial Sequence: Synthetic peptide
KQHSN

SEQ ID NO: 940 - protein, 6 aa, Artificial Sequence
  Description of Artificial Sequence: Synthetic peptide
DSVKGR

SEQ ID NO: 941 - protein, 6 aa, Artificial Sequence
  Description of Artificial Sequence: Synthetic peptide
SLRPED

SEQ ID NO: 942 - protein, 6 aa, Artificial Sequence
  Description of Artificial Sequence: Synthetic peptide
IVLYEW

SEQ ID NO: 943 - protein, 4 aa, Artificial Sequence
  Description of Artificial Sequence: Synthetic peptide
APLV

SEQ ID NO: 944 - protein, 6 aa, Artificial Sequence
  Description of Artificial Sequence: Synthetic peptide
SSMIQM

SEQ ID NO: 945 - protein, 6 aa, Artificial Sequence
  Description of Artificial Sequence: Synthetic peptide
SLRPED

SEQ ID NO: 946 - protein, 6 aa, Artificial Sequence
  Description of Artificial Sequence: Synthetic peptide
CFMCYW

SEQ ID NO: 947 - protein, 8 aa, Artificial Sequence
  Description of Artificial Sequence: Synthetic peptide
DMWGANCS

SEQ ID NO: 948 - protein, 6 aa, Artificial Sequence
  Description of Artificial Sequence: Synthetic peptide
DSVKGR

SEQ ID NO: 949 - protein, 6 aa, Artificial Sequence
  Description of Artificial Sequence: Synthetic peptide
SLRPED

SEQ ID NO: 950 - protein, 7 aa, Artificial Sequence
  Description of Artificial Sequence: Synthetic peptide
FYLAWAA

SEQ ID NO: 951 - protein, 8 aa, Artificial Sequence
  Description of Artificial Sequence: Synthetic peptide
INVGSPAY

SEQ ID NO: 952 - protein, 6 aa, Artificial Sequence
  Description of Artificial Sequence: Synthetic peptide
DSVKGR

SEQ ID NO: 953 - protein, 6 aa, Artificial Sequence
  Description of Artificial Sequence: Synthetic peptide
SLHPED

SEQ ID NO: 954 - protein, 8 aa, Artificial Sequence
  Description of Artificial Sequence: Synthetic peptide
GLSNRSGC

SEQ ID NO: 955 - protein, 8 aa, Artificial Sequence
  Description of Artificial Sequence: Synthetic peptide
CSVGISRQ

SEQ ID NO: 956 - protein, 7 aa, Artificial Sequence
  Description of Artificial Sequence: Synthetic peptide
LLLIFKF

SEQ ID NO: 957 - protein, 4 aa, Artificial Sequence
  Description of Artificial Sequence: Synthetic peptide
LMRI

SEQ ID NO: 958 - protein, 7 aa, Artificial Sequence
  Description of Artificial Sequence: Synthetic peptide
FFNSEQF

SEQ ID NO: 959 - protein, 5 aa, Artificial Sequence
  Description of Artificial Sequence: Synthetic peptide
APGKG

SEQ ID NO: 960 - protein, 9 aa, Artificial Sequence
  Description of Artificial Sequence: Synthetic peptide
FLILALTKP

SEQ ID NO: 961 - protein, 4 aa, Artificial Sequence
  Description of Artificial Sequence: Synthetic peptide
QLMI

SEQ ID NO: 962 - protein, 6 aa, Artificial Sequence
  Description of Artificial Sequence: Synthetic peptide
LVQPGN

SEQ ID NO: 963 - protein, 8 aa, Artificial Sequence
  Description of Artificial Sequence: Synthetic peptide
LRGGLHRV

SEQ ID NO: 964 - protein, 6 aa, Artificial Sequence
  Description of Artificial Sequence: Synthetic peptide
SKWACG

SEQ ID NO: 965 - protein, 8 aa, Artificial Sequence
  Description of Artificial Sequence: Synthetic peptide
VYMFNLVD

SEQ ID NO: 966 - protein, 6 aa, Artificial Sequence
  Description of Artificial Sequence: Synthetic peptide
QLETPC

SEQ ID NO: 967 - protein, 7 aa, Artificial Sequence
  Description of Artificial Sequence: Synthetic peptide
NYRWISL

SEQ ID NO: 968 - protein, 6 aa, Artificial Sequence
  Description of Artificial Sequence: Synthetic peptide
SLRPED

SEQ ID NO: 969 - protein, 6 aa, Artificial Sequence
  Description of Artificial Sequence: Synthetic peptide
LVQPGN

SEQ ID NO: 970 - protein, 5 aa, Artificial Sequence
  Description of Artificial Sequence: Synthetic peptide
APGKG

SEQ ID NO: 971 - protein, 9 aa, Artificial Sequence
  Description of Artificial Sequence: Synthetic peptide
SVLFGVAYL

SEQ ID NO: 972 - protein, 6 aa, Artificial Sequence
  Description of Artificial Sequence: Synthetic peptide
SLRPED

SEQ ID NO: 973 - protein, 8 aa, Artificial Sequence
  Description of Artificial Sequence: Synthetic peptide
FGPYNLVS

SEQ ID NO: 974 - protein, 7 aa, Artificial Sequence
  Description of Artificial Sequence: Synthetic peptide
KLSTIWM

SEQ ID NO: 975 - protein, 8 aa, Artificial Sequence
  Description of Artificial Sequence: Synthetic peptide
MRRPCVIS

SEQ ID NO: 976 - protein, 7 aa, Artificial Sequence
  Description of Artificial Sequence: Synthetic peptide
VPSYRVA

SEQ ID NO: 977 - protein, 7 aa, Artificial Sequence
  Description of Artificial Sequence: Synthetic peptide
DSGLTLR

SEQ ID NO: 978 - protein, 6 aa, Artificial Sequence
  Description of Artificial Sequence: Synthetic peptide
LLWHWD

SEQ ID NO: 979 - protein, 8 aa, Artificial Sequence
  Description of Artificial Sequence: Synthetic peptide
VTEMNAMS

SEQ ID NO: 980 - protein, 7 aa, Artificial Sequence
  Description of Artificial Sequence: Synthetic peptide
  MOD_RES (2)..(2): Any amino acid
GXTDGGT

SEQ ID NO: 981 - protein, 5 aa, Artificial Sequence
  Description of Artificial Sequence: Synthetic peptide
  MOD_RES (4)..(4): Any amino acid
FLIXF

SEQ ID NO: 982 - protein, 6 aa, Artificial Sequence
  Description of Artificial Sequence: Synthetic peptide
DSVKGR

SEQ ID NO: 983 - protein, 6 aa, Artificial Sequence
  Description of Artificial Sequence: Synthetic peptide
LKRTVY

SEQ ID NO: 984 - protein, 8 aa, Artificial Sequence
  Description of Artificial Sequence: Synthetic peptide
SICIVSFY

SEQ ID NO: 985 - protein, 5 aa, Artificial Sequence
  Description of Artificial Sequence: Synthetic peptide
TNTAS

SEQ ID NO: 986 - protein, 9 aa, Artificial Sequence
  Description of Artificial Sequence: Synthetic peptide
RGLIDNDYQ

SEQ ID NO: 987 - protein, 5 aa, Artificial Sequence
  Description of Artificial Sequence: Synthetic peptide
RQYSV

SEQ ID NO: 988 - protein, 6 aa, Artificial Sequence
  Description of Artificial Sequence: Synthetic peptide
  MOD_RES (5)..(6): Any amino acid
LSRPXX

SEQ ID NO: 989 - protein, 7 aa, Artificial Sequence
  Description of Artificial Sequence: Synthetic peptide
CPPAIMP

SEQ ID NO: 990 - protein, 6 aa, Artificial Sequence
  Description of Artificial Sequence: Synthetic peptide
DSVKGL

SEQ ID NO: 991 - protein, 6 aa, Artificial Sequence
  Description of Artificial Sequence: Synthetic peptide
SLRPED

SEQ ID NO: 992 - protein, 8 aa, Artificial Sequence
  Description of Artificial Sequence: Synthetic peptide
  MOD_RES (7)..(7): Any amino acid
FALQCPXL

SEQ ID NO: 993 - protein, 4 aa, Artificial Sequence
  Description of Artificial Sequence: Synthetic peptide
IVGN

SEQ ID NO: 994 - protein, 7 aa, Artificial Sequence
  Description of Artificial Sequence: Synthetic peptide
LINLITE

SEQ ID NO: 995 - protein, 6 aa, Artificial Sequence
  Description of Artificial Sequence: Synthetic peptide
SLCPED

SEQ ID NO: 996 - protein, 6 aa, Artificial Sequence
  Description of Artificial Sequence: Synthetic peptide
MSMSLF

SEQ ID NO: 997 - protein, 4 aa, Artificial Sequence
  Description of Artificial Sequence: Synthetic peptide
NVTL

SEQ ID NO: 998 - protein, 6 aa, Artificial Sequence
  Description of Artificial Sequence: Synthetic peptide
SDNILY

SEQ ID NO: 999 - protein, 6 aa, Artificial Sequence
  Description of Artificial Sequence: Synthetic peptide
SLRPED

SEQ ID NO: 1000 - protein, 6 aa, Artificial Sequence
  Description of Artificial Sequence: Synthetic peptide
IDVFIC

SEQ ID NO: 1001 - protein, 7 aa, Artificial Sequence
  Description of Artificial Sequence: Synthetic peptide
ISLPVMS

SEQ ID NO: 1002 - protein, 8 aa, Artificial Sequence
  Description of Artificial Sequence: Synthetic peptide
TPRTPTRP

SEQ ID NO: 1003 - protein, 6 aa, Artificial Sequence
  Description of Artificial Sequence: Synthetic peptide
SLRPED

SEQ ID NO: 1004 - protein, 6 aa, Artificial Sequence
  Description of Artificial Sequence: Synthetic peptide
LFQPGN

SEQ ID NO: 1005 - protein, 7 aa, Artificial Sequence
  Description of Artificial Sequence: Synthetic peptide
LYEPRAE

SEQ ID NO: 1006 - protein, 7 aa, Artificial Sequence
  Description of Artificial Sequence: Synthetic peptide
FLCFDLQ

SEQ ID NO: 1007 - protein, 5 aa, Artificial Sequence
  Description of Artificial Sequence: Synthetic peptide
RISAM

SEQ ID NO: 1008 - protein, 8 aa, Artificial Sequence
  Description of Artificial Sequence: Synthetic peptide
  MOD_RES (8)..(8): Any amino acid
YGNNCVLX

SEQ ID NO: 1009 - protein, 6 aa, Artificial Sequence
  Description of Artificial Sequence: Synthetic peptide
VARAYD

SEQ ID NO: 1010 - protein, 7 aa, Artificial Sequence
  Description of Artificial Sequence: Synthetic peptide
YRNHNRN

SEQ ID NO: 1011 - protein, 6 aa, Artificial Sequence
  Description of Artificial Sequence: Synthetic peptide
LVQPGN

SEQ ID NO: 1012 - protein, 5 aa, Artificial Sequence
  Description of Artificial Sequence: Synthetic peptide
APGKG

SEQ ID NO: 1013 - protein, 5 aa, Artificial Sequence
  Description of Artificial Sequence: Synthetic peptide
VACGR

SEQ ID NO: 1014 - protein, 5 aa, Artificial Sequence
  Description of Artificial Sequence: Synthetic peptide
NTTAR

SEQ ID NO: 1015 - protein, 8 aa, Artificial Sequence
  Description of Artificial Sequence: Synthetic peptide
MLTGFPFG

SEQ ID NO: 1016 - protein, 4 aa, Artificial Sequence
  Description of Artificial Sequence: Synthetic peptide
EIWW

SEQ ID NO: 1017 - protein, 6 aa, Artificial Sequence
  Description of Artificial Sequence: Synthetic peptide
DSVKGR

SEQ ID NO: 1018 - protein, 6 aa, Artificial Sequence
  Description of Artificial Sequence: Synthetic peptide
SLRPED

SEQ ID NO: 1019 - protein, 6 aa, Artificial Sequence
  Description of Artificial Sequence: Synthetic peptide
LVQPGN

SEQ ID NO: 1020 - protein, 5 aa, Artificial Sequence
  Description of Artificial Sequence: Synthetic peptide
YKEWD

SEQ ID NO: 1021 - protein, 6 aa, Artificial Sequence
  Description of Artificial Sequence: Synthetic peptide
DSVKGR

SEQ ID NO: 1022 - protein, 6 aa, Artificial Sequence
  Description of Artificial Sequence: Synthetic peptide
SLRPED

SEQ ID NO: 1023 - protein, 6 aa, Artificial Sequence
  Description of Artificial Sequence: Synthetic peptide
LVQPGN

SEQ ID NO: 1024 - protein, 5 aa, Artificial Sequence
  Description of Artificial Sequence: Synthetic peptide
APGKG

SEQ ID NO: 1025 - protein, 6 aa, Artificial Sequence
  Description of Artificial Sequence: Synthetic peptide
DSDKGR

SEQ ID NO: 1026 - protein, 6 aa, Artificial Sequence
  Description of Artificial Sequence: Synthetic peptide
SLPPQD

SEQ ID NO: 1027 - protein, 6 aa, Artificial Sequence
  Description of Artificial Sequence: Synthetic peptide
LVQPGN

SEQ ID NO: 1028 - protein, 6 aa, Artificial Sequence
  Description of Artificial Sequence: Synthetic peptide
DSVKGR

SEQ ID NO: 1029 - protein, 6 aa, Artificial Sequence
  Description of Artificial Sequence: Synthetic peptide
SLRPED

SEQ ID NO: 1030 - protein, 7 aa, Artificial Sequence
  Description of Artificial Sequence: Synthetic peptide
GLINSIA

SEQ ID NO: 1031 - protein, 6 aa, Artificial Sequence
  Description of Artificial Sequence: Synthetic peptide
RGSEGG

SEQ ID NO: 1032 - protein, 6 aa, Artificial Sequence
  Description of Artificial Sequence: Synthetic peptide
DSVKGR

SEQ ID NO: 1033 - protein, 6 aa, Artificial Sequence
  Description of Artificial Sequence: Synthetic peptide
SLRPED

SEQ ID NO: 1034 - protein, 6 aa, Artificial Sequence
  Description of Artificial Sequence: Synthetic peptide
LVQPGN

SEQ ID NO: 1035 - protein, 5 aa, Artificial Sequence
  Description of Artificial Sequence: Synthetic peptide
APGKG

SEQ ID NO: 1036 - protein, 6 aa, Artificial Sequence
  Description of Artificial Sequence: Synthetic peptide
DSVKGR

SEQ ID NO: 1037 - protein, 6 aa, Artificial Sequence
  Description of Artificial Sequence: Synthetic peptide
SLRPED

SEQ ID NO: 1038 - protein, 6 aa, Artificial Sequence
  Description of Artificial Sequence: Synthetic peptide
LIQPGN

SEQ ID NO: 1039 - protein, 6 aa, Artificial Sequence
  Description of Artificial Sequence: Synthetic peptide
  MOD_RES (1)..(1): Any amino acid
XLHGGS

SEQ ID NO: 1040 - protein, 6 aa, Artificial Sequence
  Description of Artificial Sequence: Synthetic peptide
DSVKGR

SEQ ID NO: 1041 - protein, 6 aa, Artificial Sequence
  Description of Artificial Sequence: Synthetic peptide
SLRPED

SEQ ID NO: 1042 - protein, 6 aa, Artificial Sequence
  Description of Artificial Sequence: Synthetic peptide
LVQPGN

SEQ ID NO: 1043 - protein, 5 aa, Artificial Sequence
  Description of Artificial Sequence: Synthetic peptide
LTNTS

SEQ ID NO: 1044 - protein, 6 aa, Artificial Sequence
  Description of Artificial Sequence: Synthetic peptide
SLRPED

SEQ ID NO: 1045 - protein, 6 aa, Artificial Sequence
  Description of Artificial Sequence: Synthetic peptide
LVQPGN

SEQ ID NO: 1046 - protein, 5 aa, Artificial Sequence
  Description of Artificial Sequence: Synthetic peptide
APGKG

SEQ ID NO: 1047 - protein, 7 aa, Artificial Sequence
  Description of Artificial Sequence: Synthetic peptide
GAYFTGR

SEQ ID NO: 1048 - protein, 6 aa, Artificial Sequence
  Description of Artificial Sequence: Synthetic peptide
SLRPED

SEQ ID NO: 1049 - protein, 6 aa, Artificial Sequence
  Description of Artificial Sequence: Synthetic peptide
LVQPGN

SEQ ID NO: 1050 - protein, 7 aa, Artificial Sequence
  Description of Artificial Sequence: Synthetic peptide
KQQSHIM

SEQ ID NO: 1051 - protein, 6 aa, Artificial Sequence
  Description of Artificial Sequence: Synthetic peptide
DSVKGR

SEQ ID NO: 1052 - protein, 6 aa, Artificial Sequence
  Description of Artificial Sequence: Synthetic peptide
SLRPED

SEQ ID NO: 1053 - protein, 6 aa, Artificial Sequence
  Description of Artificial Sequence: Synthetic peptide
LVQPGN

SEQ ID NO: 1054 - protein, 6 aa, Artificial Sequence
  Description of Artificial Sequence: Synthetic peptide
  MOD_RES (3)..(3): Any amino acid
LPXMKR

SEQ ID NO: 1055 - protein, 6 aa, Artificial Sequence
  Description of Artificial Sequence: Synthetic peptide
DSVKGR

SEQ ID NO: 1056 - protein, 6 aa, Artificial Sequence
  Description of Artificial Sequence: Synthetic peptide
SLRPED

SEQ ID NO: 1057 - protein, 6 aa, Artificial Sequence
  Description of Artificial Sequence: Synthetic peptide
LVQPGN

SEQ ID NO: 1058 - protein, 5 aa, Artificial Sequence
  Description of Artificial Sequence: Synthetic peptide
VGHPK

SEQ ID NO: 1059 - protein, 6 aa, Artificial Sequence
  Description of Artificial Sequence: Synthetic peptide
DSVKGR

SEQ ID NO: 1060 - protein, 6 aa, Artificial Sequence
  Description of Artificial Sequence: Synthetic peptide
SLRPED

SEQ ID NO: 1061 - protein, 6 aa, Artificial Sequence
  Description of Artificial Sequence: Synthetic peptide
LVQPGN

SEQ ID NO: 1062 - protein, 5 aa, Artificial Sequence
  Description of Artificial Sequence: Synthetic peptide
APGKG

SEQ ID NO: 1063 - protein, 6 aa, Artificial Sequence
  Description of Artificial Sequence: Synthetic peptide
DSVKGR

SEQ ID NO: 1064 - protein, 6 aa, Artificial Sequence
  Description of Artificial Sequence: Synthetic peptide
SLRPED

SEQ ID NO: 1065 - protein, 6 aa, Artificial Sequence
  Description of Artificial Sequence: Synthetic peptide
LVQPGN

SEQ ID NO: 1066 - protein, 5 aa, Artificial Sequence
  Description of Artificial Sequence: Synthetic peptide
TVTTP

SEQ ID NO: 1067 - protein, 6 aa, Artificial Sequence
  Description of Artificial Sequence: Synthetic peptide
DSVKGR

SEQ ID NO: 1068 - protein, 6 aa, Artificial Sequence
  Description of Artificial Sequence: Synthetic peptide
SLRPED

SEQ ID NO: 1069 - protein, 6 aa, Artificial Sequence
  Description of Artificial Sequence: Synthetic peptide
LVQPGN

SEQ ID NO: 1070 - protein, 6 aa, Artificial Sequence
  Description of Artificial Sequence: Synthetic peptide
SNSLNS

SEQ ID NO: 1071 - protein, 6 aa, Artificial Sequence
  Description of Artificial Sequence: Synthetic peptide
DSVKGR

SEQ ID NO: 1072 - protein, 6 aa, Artificial Sequence
  Description of Artificial Sequence: Synthetic peptide
SLRPED

SEQ ID NO: 1073 - protein, 6 aa, Artificial Sequence
  Description of Artificial Sequence: Synthetic peptide
LVQPGN

SEQ ID NO: 1074 - protein, 5 aa, Artificial Sequence
  Description of Artificial Sequence: Synthetic peptide
TSSRT

SEQ ID NO: 1075 - protein, 6 aa, Artificial Sequence
  Description of Artificial Sequence: Synthetic peptide
DSVKGR

SEQ ID NO: 1076 - protein, 7 aa, Artificial Sequence
  Description of Artificial Sequence: Synthetic peptide
FPNKAIN

SEQ ID NO: 1077 - protein, 6 aa, Artificial Sequence
  Description of Artificial Sequence: Synthetic peptide
LVQPGN

SEQ ID NO: 1078 - protein, 6 aa, Artificial Sequence
  Description of Artificial Sequence: Synthetic peptide
SNSLNS

SEQ ID NO: 1079 - protein, 6 aa, Artificial Sequence
  Description of Artificial Sequence: Synthetic peptide
DSVKGR

SEQ ID NO: 1080 - protein, 6 aa, Artificial Sequence
  Description of Artificial Sequence: Synthetic peptide
SLRPED

SEQ ID NO: 1081 - protein, 6 aa, Artificial Sequence
  Description of Artificial Sequence: Synthetic peptide
LVQPGN

SEQ ID NO: 1082 - protein, 5 aa, Artificial Sequence
  Description of Artificial Sequence: Synthetic peptide
VANLY

SEQ ID NO: 1083 - protein, 6 aa, Artificial Sequence
  Description of Artificial Sequence: Synthetic peptide
DSVKGR

SEQ ID NO: 1084 - protein, 6 aa, Artificial Sequence
  Description of Artificial Sequence: Synthetic peptide
SLRPED

SEQ ID NO: 1085 - protein, 6 aa, Artificial Sequence
  Description of Artificial Sequence: Synthetic peptide
LVQPGN

SEQ ID NO: 1086 - protein, 5 aa, Artificial Sequence
  Description of Artificial Sequence: Synthetic peptide
SEAKT

SEQ ID NO: 1087 - protein, 6 aa, Artificial Sequence
  Description of Artificial Sequence: Synthetic peptide
DSVKGR

SEQ ID NO: 1088 - protein, 6 aa, Artificial Sequence
  Description of Artificial Sequence: Synthetic peptide
SLRPED

SEQ ID NO: 1089 - protein, 6 aa, Artificial Sequence
  Description of Artificial Sequence: Synthetic peptide
LVQPGN

SEQ ID NO: 1090 - protein, 5 aa, Artificial Sequence
  Description of Artificial Sequence: Synthetic peptide
APGEG

SEQ ID NO: 1091 - protein, 6 aa, Artificial Sequence
  Description of Artificial Sequence: Synthetic peptide
DSVKGR

SEQ ID NO: 1092 - protein, 6 aa, Artificial Sequence
  Description of Artificial Sequence: Synthetic peptide
SLRPED

SEQ ID NO: 1093 - protein, 6 aa, Artificial Sequence
  Description of Artificial Sequence: Synthetic peptide
LVQPGN

SEQ ID NO: 1094 - protein, 7 aa, Artificial Sequence
  Description of Artificial Sequence: Synthetic peptide
NMIRYPK

SEQ ID NO: 1095 - protein, 6 aa, Artificial Sequence
  Description of Artificial Sequence: Synthetic peptide
DSVKGR

SEQ ID NO: 1096 - protein, 6 aa, Artificial Sequence
  Description of Artificial Sequence: Synthetic peptide
SLRPED

SEQ ID NO: 1097 - protein, 6 aa, Artificial Sequence
  Description of Artificial Sequence: Synthetic peptide
LVQPGN

SEQ ID NO: 1098 - protein, 5 aa, Artificial Sequence
  Description of Artificial Sequence: Synthetic peptide
APGKG

SEQ ID NO: 1099 - protein, 6 aa, Artificial Sequence
  Description of Artificial Sequence: Synthetic peptide
DSVKGR

SEQ ID NO: 1100 - protein, 6 aa, Artificial Sequence
  Description of Artificial Sequence: Synthetic peptide
SLRPED

SEQ ID NO: 1101 - protein, 7 aa, Artificial Sequence
  Description of Artificial Sequence: Synthetic peptide
VAVLRGE

SEQ ID NO: 1102 - protein, 5 aa, Artificial Sequence
  Description of Artificial Sequence: Synthetic peptide
RALNL

SEQ ID NO: 1103 - protein, 6 aa, Artificial Sequence
  Description of Artificial Sequence: Synthetic peptide
DSVKGR

SEQ ID NO: 1104 - protein, 6 aa, Artificial Sequence
  Description of Artificial Sequence: Synthetic peptide
SLRPED

SEQ ID NO: 1105 - protein, 7 aa, Artificial Sequence
  Description of Artificial Sequence: Synthetic peptide
AAADNGV

SEQ ID NO: 1106 - protein, 5 aa, Artificial Sequence
  Description of Artificial Sequence: Synthetic peptide
APGKG

SEQ ID NO: 1107 - protein, 6 aa, Artificial Sequence
  Description of Artificial Sequence: Synthetic peptide
DSVKGR

SEQ ID NO: 1108 - protein, 6 aa, Artificial Sequence
  Description of Artificial Sequence: Synthetic peptide
SLRPED

SEQ ID NO: 1109 - protein, 6 aa, Artificial Sequence
  Description of Artificial Sequence: Synthetic peptide
LVQPGN

SEQ ID NO: 1110 - protein, 5 aa, Artificial Sequence
  Description of Artificial Sequence: Synthetic peptide
TSRNG

SEQ ID NO: 1111 - protein, 6 aa, Artificial Sequence
  Description of Artificial Sequence: Synthetic peptide
DSVKGR

SEQ ID NO: 1112 - protein, 6 aa, Artificial Sequence
  Description of Artificial Sequence: Synthetic peptide
SLRPED

SEQ ID NO: 1113 - protein, 6 aa, Artificial Sequence
  Description of Artificial Sequence: Synthetic peptide
LVQPGN

SEQ ID NO: 1114 - protein, 5 aa, Artificial Sequence
  Description of Artificial Sequence: Synthetic peptide
TNLSY

SEQ ID NO: 1115 - protein, 6 aa, Artificial Sequence
  Description of Artificial Sequence: Synthetic peptide
DSVKGR

SEQ ID NO: 1116 - protein, 6 aa, Artificial Sequence
  Description of Artificial Sequence: Synthetic peptide
SLRPED

SEQ ID NO: 1117 - protein, 6 aa, Artificial Sequence
  Description of Artificial Sequence: Synthetic peptide
LVQPGN

SEQ ID NO: 1118 - protein, 7 aa, Artificial Sequence
  Description of Artificial Sequence: Synthetic peptide
VKKSQNS

SEQ ID NO: 1119 - protein, 6 aa, Artificial Sequence
  Description of Artificial Sequence: Synthetic peptide
DSVRGR

SEQ ID NO: 1120 - protein, 6 aa, Artificial Sequence
  Description of Artificial Sequence: Synthetic peptide
SLRPED

SEQ ID NO: 1121 - protein, 6 aa, Artificial Sequence
  Description of Artificial Sequence: Synthetic peptide
LVQPGN

SEQ ID NO: 1122 - protein, 6 aa, Artificial Sequence
  Description of Artificial Sequence: Synthetic peptide
ADDRTH

SEQ ID NO: 1123 - protein, 6 aa, Artificial Sequence
  Description of Artificial Sequence: Synthetic peptide
YSVKGR

SEQ ID NO: 1124 - protein, 6 aa, Artificial Sequence
  Description of Artificial Sequence: Synthetic peptide
SLRPED

SEQ ID NO: 1125 - protein, 6 aa, Artificial Sequence
  Description of Artificial Sequence: Synthetic peptide
LVQPGN

SEQ ID NO: 1126 - protein, 5 aa, Artificial Sequence
  Description of Artificial Sequence: Synthetic peptide
APGKG

SEQ ID NO: 1127 - protein, 6 aa, Artificial Sequence
  Description of Artificial Sequence: Synthetic peptide
DSVKGR

SEQ ID NO: 1128 - protein, 6 aa, Artificial Sequence
  Description of Artificial Sequence: Synthetic peptide
SLRPED

SEQ ID NO: 1129 - protein, 6 aa, Artificial Sequence
  Description of Artificial Sequence: Synthetic peptide
LVQPGN

SEQ ID NO: 1130 - protein, 5 aa, Artificial Sequence
  Description of Artificial Sequence: Synthetic peptide
  MOD_RES (4)..(4): Any amino acid
APNXV

SEQ ID NO: 1131 - protein, 5 aa, Artificial Sequence
  Description of Artificial Sequence: Synthetic peptide
  MOD_RES (4)..(4): Any amino acid
SADXG

SEQ ID NO: 1132 - protein, 6 aa, Artificial Sequence
  Description of Artificial Sequence: Synthetic peptide
  MOD_RES (2)..(2): Any amino acid
SXNPQD

SEQ ID NO: 1133 - protein, 6 aa, Artificial Sequence
  Description of Artificial Sequence: Synthetic peptide
  MOD_RES (6)..(6): Any amino acid
PGGEGX

SEQ ID NO: 1134 - protein, 5 aa, Artificial Sequence
  Description of Artificial Sequence: Synthetic peptide
  MOD_RES (1)..(1): Any amino acid
XSISP

SEQ ID NO: 1135 - protein, 6 aa, Artificial Sequence
  Description of Artificial Sequence: Synthetic peptide
DSVKGR

SEQ ID NO: 1136 - protein, 6 aa, Artificial Sequence
  Description of Artificial Sequence: Synthetic peptide
SLPPED

SEQ ID NO: 1137 - protein, 6 aa, Artificial Sequence
  Description of Artificial Sequence: Synthetic peptide
LVQPGN

SEQ ID NO: 1138 - protein, 5 aa, Artificial Sequence
  Description of Artificial Sequence: Synthetic peptide
APGKG

SEQ ID NO: 1139 - protein, 6 aa, Artificial Sequence
  Description of Artificial Sequence: Synthetic peptide
DSVKGR

SEQ ID NO: 1140 - protein, 6 aa, Artificial Sequence
  Description of Artificial Sequence: Synthetic peptide
SLRPED

What is claimed is:

1. A conditionally active binding protein comprising
a) a binding moiety (M) which comprises a non-CDR loop, wherein the binding moiety (M) comprises a serum albumin binding domain and the non-CDR loop comprises a binding site specific for a CD3ε domain, and wherein the binding moiety further comprises complementarity determining regions (CDRs),
(b) a cleavable linker (L),
(c) a first target antigen binding domain (T1) comprising an immunoglobulin molecule that binds to CD3ε, and
(d) a second target antigen binding domain (T2),
wherein the binding moiety (M) is capable of masking the binding of the first target antigen binding domain (T1) to CD3ε.

2. The conditionally active binding protein of claim 1, wherein the binding moiety is capable of binding to a half-life extending protein.

3. The conditionally active binding protein of claim 1, wherein the binding moiety is a natural peptide, a synthetic peptide, an engineered scaffold, or an engineered serum bulk protein.

4. The conditionally active binding protein of claim 3, wherein the engineered scaffold comprises an sdAb, an scFv, a Fab, a VHH, a fibronectin type III domain, an immunoglobulin-like scaffold, a DARPin, a cystine knot peptide, a lipocalin, a three-helix bundle scaffold, a protein G-related albumin-binding module, or a DNA or RNA aptamer scaffold.

5. The conditionally active binding protein of claim 1, wherein the non-CDR loop is from a variable domain, a constant domain, a C1-set domain, a C2-set domain, an I-domain, or any combinations thereof.

6. The conditionally active binding protein of claim 1, wherein the binding site is capable of binding to a human serum albumin.

7. The conditionally active binding protein of claim 6, wherein the CDRs provide the binding site specific for the serum albumin.

8. The conditionally active binding protein of claim 1, wherein the non-CDR loop provides the binding site specific for binding of the binding moiety to the first target antigen binding domain.

9. The conditionally active binding protein of claim 1, wherein the the second target antigen binding domain binds to a tumor antigen.

10. The conditionally active binding protein of claim 9, wherein the tumor antigen comprises EpCAM, EGFR, HER-2, HER-3, c-Met, FoIR, PSMA, CD38, BCMA, CEA, 5T4, AFP, B7-H3, CDH-6, CAIX, CD117, CD123, CD138, CD166, CD19, CD20, CD205, CD22, CD30, CD33, CD352, CD37, CD44, CD52, CD56, CD70, CD71, CD74, CD79b, DLL3, EphA2, FAP, FGFR2, FGFR3, GPC3, gpA33, FLT-3, gpNMB, HPV-16 E6, HPV-16 E7, ITGA2, ITGA3, SLC39A6, MAGE, mesothelin, Muc1, Muc16, NaPi2b, Nectin-4, CDH-3, CDH-17, EPHB2, ITGAV, ITGB6, NY-ESO-1, PRLR, PSCA, PTK7, RORI, SLC44A4, SLITRK5, SLITRK6, STEAP1, TIM1, Trop2, or WT1.

11. The conditionally active binding protein of claim 1, wherein the first target antigen binding domain binds to a human CD3ε.

12. The conditionally active binding protein of claim 1, wherein the binding moiety (M), the cleavable linker (L), the first target antigen binding domain (T1), and the second target antigen binding domain (T2) are in one of the following configurations: M:L:T1:T2, and T2:T1:L:M.

13. The conditionally active binding protein of claim 1, wherein the cleavable linker comprises a cleavage site.

14. The conditionally active binding protein of claim 13, wherein the cleavage site is recognized by a protease.

15. The conditionally active binding protein of claim 14, wherein the protease cleavage site is recognized by a serine protease, a cysteine protease, an aspartate protease, a threonine protease, a glutamic acid protease, a metalloproteinase, a gelatinase, or an asparagine peptide lyase.

16. The conditionally active binding protein of claim 14, wherein the protease cleavage site is recognized by a Cathepsin B, a Cathepsin C, a Cathepsin D, a Cathepsin E, a Cathepsin K, a Cathepsin L, a kallikrein, a hK1, a hK10, a hK15, a plasmin, a collagenase, a Type IV collagenase, a stromelysin, a Factor Xa, a chymotrypsin-like protease, a trypsin-like protease, a elastase-like protease, a subtilisin-like protease, an actinidain, a bromelain, a calpain, a caspase, a caspase-3, a Mir1-CP, a papain, a HIV-1 protease, a HSV protease, a CMV protease, a chymosin, a renin, a pepsin, a matriptase, a legumain, a plasmepsin, a nepenthesin, a metalloexopeptidase, a metalloendopeptidase, a matrix metalloprotease (MMP), a MMP1, a MMP2, a MMP3, a MMP8, a MMP9, a MMP10, a MMP11, a MMP12, a MMP13, a MMP14, an ADAM10, an ADAM12, an urokinase plasminogen activator (uPA), an enterokinase, a prostate-specific target (PSA, hK3), an interleukin-1β converting enzyme, a thrombin, a FAP, a dipeptidyl peptidase, or dipeptidyl peptidase IV (DPPIV/CD26), a type II transmembrane serine protease (TTSP), a neutrophil elastase, a cathepsin G, a proteinase 3, a neutrophil serine protease 4, a mast cell chymase, a mast cell tryptase, a dipeptidyl peptidase, or a dipeptidyl peptidase IV (DPPIV/CD26).

17. The conditionally active binding protein of claim 11, wherein the binding moiety comprises a binding site specific the first target antigen binding domain (T1), and wherein the binding site comprises at least one of the following motifs: QDGNE (SEQ ID NO: 921), QDGNEE (SEQ ID NO: 801), DGNE (SEQ ID NO: 922), and DGNEE (SEQ ID NO: 923).

18. The conditionally active binding protein of claim 13, wherein upon cleavage of the cleavable site in a tumor microenvironment, the conditionally active binding protein is activated by separation of the binding moiety.

19. The conditionally active binding protein of claim 1, wherein the binding moiety comprises a sequence selected from the group consisting of SEQ ID Nos. 50 and 259-301.

20. The conditionally active binding protein of claim 1, wherein the binding moiety comprises an sdAb.

* * * * *